United States Patent 11,446,398 (REGULATED BIOCIRCUIT SYSTEMS) - sequence listing, part 41

SEQ ID NO: 128797 - DNA, 498 bp, Homo sapiens
  Payload ID: 5192
  Gene Symbol: DMPK
  Gene Name: dystrophia myotonica-protein kinase
  ENST ID: ENST00000596067
  CDS Start-End: 123-498
taggaccttgacttctgagaggcctgattgtcatctgtaaataaggggtaggactaaagcactcctcctggaggactgagagatgggctggaccggagcacttgagtctgggatatgtgaccatgctacctttgtctccctgtcctgttccttcccccagccccaaatccagggttttccaaagtgtggttcaagaaccacctgcatctgaatctagagcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctgg

SEQ ID NO: 128798 - DNA, 803 bp, Homo sapiens
  Payload ID: 5192
  Gene Symbol: DMPK
  Gene Name: dystrophia myotonica-protein kinase
  ENST ID: ENST00000597660
  CDS Start-End: 1-567
gccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatgtaagacccctctctttcccctgcctcagacctgctgcccattctgcagatcccctccctggctcctggtctccccgtccagatatagggctcaccctacgtctttgcgactttagagggcagaagccctttattcagccccagatctccctccgttcaggcctcaccagattccctccgggatctccctagataacctccccaacctcgattcccctcgctgtctctcgccccaccgctgagggctgggctgggctccgatcgggtcacctgtcccttctctctccagctagatggccccccggccgtggctgtgggccagtgcccgctggtggggccaggccccatgcaccgccgccacctgctgctccctgccagggtacgtccggctgcccacgcccccctccgccgtcgcgccccgcgctcca

SEQ ID NO: 128799 - DNA, 3357 bp, Homo sapiens
  Payload ID: 5192
  Gene Symbol: DMPK
  Gene Name: dystrophia myotonica-protein kinase
  ENST ID: ENST00000600757
  CDS Start-End: 689-2596
ggaaccccccggaacccctctctttcctccagaacccactgtctcctctccttccctcccctcccatacccatccctctctccatcctgcctccacttcttccacccccgggagtccaggcctccctgtccccacagtccctgagccacaagcctccaccccagctggtcccccacccaggctgcccagtttaacattcctagtcataggaccttgacttctgagaggcctgattgtcatctgtaaataaggggtaggactaaagcactcctcctggaggactgagagatgggctggaccggagcacttgagtctgggatatgtgaccatgctacctttgtctccctgtcctgttccttcccccagccccaaatccagggttttccaaagtgtggttcaagaaccacctgcatctgaatctagaggtactggatacaaccccacgtctgggccgttacccaggacattctacatgagaacgtgggggtggggccctggctgcacctgaactgtcacctggagtcagggtggaaggtggaagaactgggtcttatttccttctccccttgttctttagggtctgtccttctgcagactccgttaccccaccctaaccatcctgcacacccttggagccctctgggccaatgccctgtcccgcaaagggcttctcaggcatctcacctctatgggagggcatttttggcccccagaaccttacacggtgtttatgtggggaagcccctgggaagcagacagtcctagggtgaagctgagaggcagagagaaggggagacagacagagggtggggctttcccccttgtctccagtgccctttctggtgaccctcggttcttttcccccaccacccccccagcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgccc

SEQ ID NO: 128800 - DNA, 2503 bp, Homo sapiens
  Payload ID: 5192
  Gene Symbol: DMPK
  Gene Name: dystrophia myotonica-protein kinase
  Uniprot ID: Q09013
  ENST ID: ENST00000618091
  CDS Start-End: 37-1914
cggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacag

SEQ ID NO: 128801 - DNA, 3856 bp, Homo sapiens
  Payload ID: 5193
  Gene Symbol: DMD
  Gene Name: dystrophin
  ENST ID: ENST00000288447
  CDS Start-End: 177-2495
atgcgaaaggggagctgttggaattcaaatagactttctggttcccagcagtcggcagtaatagaatgctttcaggaagatgacagaatcaggagaaagatgctgttttgcactatcttgatttgttacagcagccaacttattggcatgatggagtgacaggaaaaacagctggcatggaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgtaggttatgcattaatttttatatctgtactcattttgtgctgcttgtaaactccgtgctttgttatctgtgattctactagttgatagattaatgcgatatgataaaatgctgtttaatatgtcttaaaaatatattttagatagcaagcaaaatcaaagtttagcctagagaaatctttctggattcttctgtgactgactagggatgcctttcataaacttgccttaacttacatattatttaactataaattaacaattttatgacattaattcatgttgattcctttcatatattgttcagttacctcaaggctaggccttagcaagcttgcacaattgtgtagagtagaatagagtaaaatagaatagaataatataatagataccatacttaggactatgtctatattctcactgttatcaaaaagttattctttatagtcatcaatccctgtcatatattataagatatttaaatttcccagatatttgtgtattaccttatctaaaaggtgtccagcctttctcagtatttacatgtggtagcagatgctttgttgttgttattcccttctgagatggtataattttgaccttcacaaataggaagttttattaatttaatataaagtgtttcatctttagggaaattgtcaaggctttaatttttcaacttcaacaattataaaacatgcatctttgtatatgattggcaacagtttgtaaaataatttctaacaggcagagtaaataaaatgggcaagctaaggaagcagtgattatgaatgaaaagtaattttatccatgggaagatcacatctaaatgtgtatattagctctgctttttctctccaggattcaaatcatgaagttcaaaatccattgtatttttacaaatacgacattacctcagttacaagctaatgtttgctgttggggttggaacttttggagatcaacaaaagatatatatatattctggaaaaaaaatctattttttaggctgcttgaaaaagggaagacaattttgtcaccagttcttcttagagttaactacttataaattggaaagctattttaaattacttattagctttataagacatgctgttgtcagcattataatagactattctaaattgtttcaagaaatgggaaatatgaaaactgaaagataatatataattgtagaaaattagctaaatgtcttttttcaagtatacttctttgaaggtaaattgtttgctgtgatttttgagggaaattctcttagtagtagaaaattaattagagaacattaaactctaattttcaaacatcatgttacatatttgaccactgaaagtatgaatcacctttagcattttattagctaattaaaaatgattattgatctgattctcaca

SEQ ID NO: 128802 - DNA, 5623 bp, Homo sapiens
  Payload ID: 5193
  Gene Symbol: DMD
  Gene Name: dystrophin
  ENST ID: ENST00000343523
  CDS Start-End: 62-2932
gggttttctcaggattgctatgcaacaggatcagtgctgtagtgcccggttcaagctgaaaatgttacacaggaagacataccatgtaaaggacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 128803 - DNA, 6773 bp, Homo sapiens
  Payload ID: 5193
  Gene Symbol: DMD
  Gene Name: dystrophin
  ENST ID: ENST00000358062
  CDS Start-End: 1-4161
gtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaag

SEQ ID NO: 128804 - DNA, 7339 bp, Homo sapiens
  Payload ID: 5193
  Gene Symbol: DMD
  Gene Name: dystrophin
  ENST ID: ENST00000359836
  CDS Start-End: 1042-4734
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 128805 - DNA, 2224 bp, Homo sapiens
  Payload ID: 5193
  Gene Symbol: DMD
  Gene Name: dystrophin
  Uniprot ID: P11532
  ENST ID: ENST00000361471
  CDS Start-End: 79-1947
actttcggggagcccggcggctctgggaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggt

SEQ ID NO: 128806 - DNA, 13956 bp, Homo sapiens
  Payload ID: 5193
  Gene Symbol: DMD
  Gene Name: dystrophin
  ENST ID: ENST00000357033
  CDS Start-End: 208-11265
gggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 128807 - DNA, 13932 bp, Homo sapiens
  Payload ID: 5193
  Gene Symbol: DMD
  Gene Name: dystrophin
  ENST ID: ENST00000378677
  CDS Start-End: 196-11241
gtgcaaaaagattgtgtgtttgtctgcttttgtgaggctggtcagagattctgtgcctgctttatctgtgcttggctatgactctacctccaggtttaccataccccatagaatgtgtaagagaaaagtaccaacagggaaatcagcaaaaagctttcctatgaaggtgtgtagccagcctccgcagaatttgaaatgtctgaggtctcatctgatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 128808 - DNA, 1858 bp, Homo sapiens
  Payload ID: 5193
  Gene Symbol: DMD
  Gene Name: dystrophin
  Uniprot ID: P11532
  ENST ID: ENST00000378680
  CDS Start-End: 121-1698
gctttcagctgtgagcttgggcggcggcggcggcggcgctccactttcggggagcccggcggctctgggaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgtt

SEQ ID NO: 128809 - DNA, 2617 bp, Homo sapiens
  Payload ID: 5193
  Gene Symbol: DMD
  Gene Name: dystrophin
  Uniprot ID: P11532
  ENST ID: ENST00000378702
  CDS Start-End: 29-1882
cacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaattt

SEQ ID NO: 128810 - DNA, 714 bp, Homo sapiens
  Payload ID: 5193
  Gene Symbol: DMD
  Gene Name: dystrophin
  ENST ID: ENST00000378705
  CDS Start-End: 1-714
ttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcagagatgatgaacatttg

SEQ ID NO: 128811 - DNA, 7410 bp, Homo sapiens
  Payload ID: 5193
  Gene Symbol: DMD
  Gene Name: dystrophin
  ENST ID: ENST00000378707
  CDS Start-End: 1042-4719
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 128812 - DNA, 4645 bp, Homo sapiens
  Payload ID: 5193
  Gene Symbol: DMD
  Gene Name: dystrophin
  Uniprot ID: P11532
  ENST ID: ENST00000378723
  CDS Start-End: 124-2031
agtgctttcagctgtgagcttgggcggcggcggcggcggcgctccactttcggggagcccggcggctctgggaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagta

SEQ ID NO: 128813 - DNA, 123 bp, Homo sapiens
  Payload ID: 5193
  Gene Symbol: DMD
  Gene Name: dystrophin
  ENST ID: ENST00000448370
  CDS Start-End: 1-123
atgctttggtgggaagaagtagaggactgttatgaaagagaagatgttcaaaagaaaacattcacaaaatgggtaaatgcacaattttctaaggaataccagaaacacatggaaacttttgac

SEQ ID NO: 128814 - DNA, 375 bp, Homo sapiens
  Payload ID: 5193
  Gene Symbol: DMD
  Gene Name: dystrophin
  ENST ID: ENST00000447523
  CDS Start-End: 1-375
gagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtattgggagatcgatgggcaaacatctgtagatggacagaagaccgctgggttcttttacaagacatccttctcaaatggcaacgtcttactgaagaacagtgcctttttagtgcatggctttcagaa

SEQ ID NO: 128815 - DNA, 303 bp, Homo sapiens
  Payload ID: 5193
  Gene Symbol: DMD
  Gene Name: dystrophin
  ENST ID: ENST00000420596
  CDS Start-End: 1-303
atgctttggtgggaagaagtagaggactgttatgaaagagaagatgttcaaaagaaaacattcacaaaatgggtaaatgcacaattttctaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgac

SEQ ID NO: 128816 - DNA, 362 bp, Homo sapiens
  Payload ID: 5193
  Gene Symbol: DMD
  Gene Name: dystrophin
  ENST ID: ENST00000471779
  CDS Start-End: 1-93
gtggaagagattttgtctaaagggcagcatttgtacaaggaaaaaccagccactcagccagtgaagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaa

SEQ ID NO: 128817 - DNA, 5209 bp, Homo sapiens
  Payload ID: 5193
  Gene Symbol: DMD
  Gene Name: dystrophin
  ENST ID: ENST00000474231
  CDS Start-End: 1042-4773
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatc

SEQ ID NO: 128818 - DNA, 616 bp, Homo sapiens
  Payload ID: 5193
  Gene Symbol: DMD
  Gene Name: dystrophin
  ENST ID: ENST00000493412
  CDS Start-End: 1-405
gaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaagatgaactaatgacttatcggtatatggacgacttcttactcatgttagcccattcatttcatcagagcatcttcacacatcagtgttcactctctatagatttatttgcatattgtctaaatatgtttttttctgttattattttacactttttattttgcttcattctctgttgagttcctcaaacctttaaaaaggaaataaataacttattcactta

SEQ ID NO: 128819 - DNA, 7080 bp, Homo sapiens
  Payload ID: 5193
  Gene Symbol: DMD
  Gene Name: dystrophin
  ENST ID: ENST00000541735
  CDS Start-End: 1042-4389
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 128820 - DNA, 13746 bp, Homo sapiens
  Payload ID: 5193
  Gene Symbol: DMD
  Gene Name: dystrophin
  ENST ID: ENST00000620040
  CDS Start-End: 1-11055
atgctttggtgggaagaagtagaggactgttatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggtaagtctttttgttttttcgaaacataccttttgcctccagaggcaaaagacgggtgaggaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 128821 - DNA, 13734 bp, Homo sapiens
  Payload ID: 5193
  Gene Symbol: DMD
  Gene Name: dystrophin
  ENST ID: ENST00000619831
  CDS Start-End: 1-11043
atgtctgaggtctcatctgatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggtaagtctttttgttttttcgaaacataccttttgcctccagaggcaaaagacgggtgaggaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 128822 - DNA, 3036 bp, Homo sapiens
  Payload ID: 5194
  Gene Symbol: DRP2
  Gene Name: dystrophin related protein 2
  ENST ID: ENST00000372916
  CDS Start-End: 319-1380
agggaagtgggagagacagagggagagtgtgcatacagcagctgtcggcatccctgtctcagggacttctttgctgattcacagaggcagcccagccccggcctcccagcttacagctgccgcctgcttctcagacctgacggaatcagaagctacataatattcgccgtgtgagtggctatcgtaatagataacatttgaatatctactaaatgccagaaactatgaattaactcctctcaacaaagctaagaggtgcttaatgatcaatagttggtgcactgcctatcctcatcccccccatgagccttggtttttatgcaacctatggtcatgcagggatgcccttacaccctcccacgatgtcatgactggcaggcagctgaccagttccatcatagcagcagcctccgaagcacctgcccccaccctcaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccgcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggcctttatggaagaagtcaagtctcggggcccctacatctattctgtgctggagtcagctcaggccttcctgtcccagcacccatttgaggagttagaggagcctcattctgagagcaaagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctgagccaagctgagggagtccgagccacttgggagcccattggggatctcttcattgattcactcccagagcacatccaggctattaagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggcgtcagttagtgagaggcttaagcagctccaggatgcccaccgggactttgggcctgggtcacagcactttctctcctgtacgtgaaccaaactggactccacttagcagaacctcagccatcttcctggagagtctattgttatcccctggggccctggtgggagcccagtataccttgacatccgagaagcacctctgtccaggttccctgggaaagagcaatttcacccaataaagttccctactacatcaaccaccaggctcagaccacatgctgggaccatcccaagatgacagagttataccaaaccctagctgatctgaacaacattaagttctcagcttatcgcactgccatgaaactccgcagagtccagaaagccctgcgcttggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaacgtgccactctgtgtggacatgagcctcaattggctcctcaatgtttttgatagtggtcgcagcggaaagatgcgggcattgtcttttaagactggcattgcatgcttgtgtggcacggaagtgaaggaaaaacttcagtacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtagggaaaacaatacctgctgggatgataataataaatatgtcatgtgacatataactcagatattaaaaaataaagtgtcacctaattattatataattacagctagtctattgtacattattatatactgttataatcctttatattgcagaatgtttaattgtttttaaatgggaagtgaggaaatattttgttttagttgtattataaagtattacagacctacaaaaatgtatagaagaacataggtgtaagagcacctatgtactaaatggtatgccagcaaatggttcacaacctactctctagaaagaaaaaaggaaagctgatctgtagcatttgctaatttctgtgatgtatatactcccactgtgaatgacatcaggctatttacaagaggtctctgagcagagtcagaaacagatcctcagttgcacaccatttatatagtatgtcaaccatgcagatacaatagatgttaagtaacctcaagaacatagagagtagcaaagtaattaggaagtaatgagttttgagtatttattacctttgtttgtaatataatttatttaattgtgagtttatataatttaataatggctagatttaacaactggcttagaaaacccctgaaattttaacagccaactgtcgtgagctggtatgagctggcatcagcacaccacagtatatacctgtgaccaacttaaggaataaaacattactgcaataca

SEQ ID NO: 128823 - DNA, 7277 bp, Homo sapiens
  Payload ID: 5194
  Gene Symbol: DRP2
  Gene Name: dystrophin related protein 2
  Uniprot ID: Q13474
  ENST ID: ENST00000395209
  CDS Start-End: 528-3401
cgctttcctcctctgcttctaatgaattgacatctccaagagccgccacatctctggtagttttacaaaactgtccttgctcttcctgcgtttgcccagtcaagggtatttttgcctgaggtcggaatgatgctgttagtcctggtgatatgattgcatagcaacacagagcagctctgagaggggaggaggaggagaagaaggaagacagggaagtgggagagacagagggagagtgtgcatacagcagctgtcggcatccctgtctcagggacttctttgctgattcacagaggcagcccagccccggcctcccagcttacagctgccgcctgcttctcagacctgacggaatcagaagctacataatattcgccgtgtgagtggctatcgtaatagataacatttgaatatctactaaatgccagaaactatgaattaactcctctcaacaaagctaagaggtgcttaatgatcaatagttggtgcactgcctatcctcatcccccccatgagccttggtttttatgcaacctatggtcatgcagggatgcccttacaccctcccacgatgtcatgactggcaggcagctgaccagttccatcatagcagcagcctccgaagcacctgcccccaccctcaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccgcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggcctttatggaagaagtcaagtctcggggcccctacatctattctgtgctggagtcagctcaggccttcctgtcccagcacccatttgaggagttagaggagcctcattctgagagcaaagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctgagccaagctgagggagtccgagccacttgggagcccattggggatctcttcattgattcactcccagagcacatccaggctattaagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggcgtcagttagtgagaggcttaagcagctccaggatgcccaccgggactttgggcctgggtcacagcactttctctcctcctctgtccaggttccctgggaaagagcaatttcacccaataaagttccctactacatcaaccaccaggctcagaccacatgctgggaccatcccaagatgacagagttataccaaaccctagctgatctgaacaacattaagttctcagcttatcgcactgccatgaaactccgcagagtccagaaagccctgcgcttggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaacgtgccactctgtgtggacatgagcctcaattggctcctcaatgtttttgatagtggtcgcagcggaaagatgcgggcattgtcttttaagactggcattgcatgcttgtgtggcacggaagtgaaggaaaaacttcagtacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtaccggagtctgaagcaattcaacgttgacatctgccagacctgcttcttgacaggcagggccagcaaaggcaataagctgcactaccccatcatggagtattacacaccgaccacatccagtgagaacatgagggactttgccacaaccttaaagaacaaattccgctccaagcattatttcagcaaacaccctcagcgaggttatctgcctgtgcaatcagtgctggaggctgactacagtgagacgccggcttcttccccgatgtggccacacgccgacacacactcccgaattgagcattttgccagcaggcttgctgagatggaaagtcaaaattgctccttctttaatgacagcttgtccccagatgacagcatagacgaggaccagtacctgctgcggcactccagccccatcacagaccgggagccagcctttggacagcaggctccatgcagtgtggccacagaaagcaaaggggagctacagaagatcctggcccacttggaagatgagaaccggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcagccacccaccgaatcagatggcagtggctctgcaggctcgtccctagcttcctctccacagcagtcagaaggcagtcacccccgggagaagggacagactactccagataccgaggctgcagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagacaccttccccaccccaagtgcccctgaaaaagtctgggcagtgtgtgttctattacttcagctccaggacagattgctagccatcctaatgctacctaggtattggtttctcctcaaatatcttcattttctttagcctcagtccctgacagaccttccttaaggggagaacagttcattctggttcttctacgttatatttggaagcattaaatccatacttatgggtttagattttttttttgccccacatcttcctatttcttaaagtcctcagcattttgagagacccactgagttgcgagttgctctggaaacctggctgaagccaccctttgctcctctgagtctgtcctcacagacctgaggacacagtggcagcttgctgagcaagggagtgttgctttccttgggtaaggaagaggaagcccacctcaagtctggagtagtatgactgccatccaacacccttccaggctgtgacccttctagctctcaggctgaatcaggtgaggtggctgattgtccccagctaatcataaggcatttgcaactggctaccgtgtgtagtggcccctccataggagccacaggccacaaatcaggaagctggccactttccacccagacaacaacagcaaggccttcctgtgcctaaaattgttatttctaactctggaaggtgaatccaatcctcaaactgaactagctcttcctaggcgacatataccatgatctctttatccagaaactgttcagaatagatagtaggggtgggggagtgggcttgggaatgttgaatagattcagagcccacttaggcagctttctcccaagaggagctttataacctagagccctgcagttgacttcatttgcctaagtttatatacatacatatctattctacatatctactgtacatcagtgctctcctggcctcactcacacattaaattctaatacctcttgaagtattaatgttctgccttgctctttgttagccccagcctctggttggaaagatagatgtatcctggctgttcccctaggatatctctctccattgatgtttggggtgggctgtcctcaagaccaaagcaacagaaacctgtggtcacagagaatctaacaggaagagtcactgttctcttcactcattccaaatcttgttcccttgagacctgggccttgggtgaattttcctgggctcccctaaatggttcaggtgccaaaatagagcaaacccaagctctgcccaccccatgcagaaaaggacaaacaggcctttattagcctttgccagctaagacacagagaacattctctggtcccttccagctcttatggtctcactcagggctaaagaaagcaacagttgccaccacaatcaggagggagtgacggttggggtgttgtattataatccagcagtgggccagtgggtagaactgctaggaacctagtttgatctgctgcaggggaggcagggcagtggcttgggtccagaagcttagggttgcctcctccaccactaagtcacaggtccagggtgtcagacttcacagcataacatctgccttagtgttcatgaggtctctgggcaggagaactgggtatctggatagatggttgagcaggtggtaggcgggcatcaatcatagaacctgggcatcagtcagagtgggagcatatttgtagaagcctagattgtgggcgggaatgtgggacggagggctcaaggactttggaggcatatgcctgcctaagccttaggcgggtacatgttatggagcaattttttaccaggaaagtcctggaaaatcttttctgttatccccaccccacctgagagctcttgggctgctgagggcctgtggcaactgcagtgggccaggcatggtagaaaagatgtagatcttgttatgtaggatttgcgttgtaggtggactgaagcagcaggtcaagagttgaattctcactaaggggtcactgacattttgtggtcctgtgtttaccttaatgcctaaggtgagtgtattgttcaagggtccagggacagtcactgcagtatgtgtggggaattttcccacagtaaggtaaatggatccttgggtactatgaatccaacttggggttggatttaccaaaatgtgttgtatgttgttagacatcttgttgtgtattagtcttctaaggatattgtgcatggcactgtgtagtttatagccctacactggaaggatggtgaagggagttgctagattgatagcctaaagaaaaccttctgactgtgggattagcatcaatgataaggaatgtgagcatttgctggggttgttgtcaaatagtatcagagaacagttaggactgagaggtgatttcttcttgacagaatttgatagaggccaaaaagccattacgaggatacctctgcttccagtgacagcagagtggattcacattgattgggcattgtcacggaaggctgactagctggaggacatcaggctgtgctatgcttccctagggaggacatgtgcccttccctccagattagaaaggctagaatcaagagtttcaagtgctcattttcttcaaggtccaaggttgggaactatttccctacagagaaatctgtttgagtttctggtgctccaggaaatgggttggcaggacacagaaatgagaaaccctgaggccaggaagaggccaatcctaggagatgttttccctccagattcattttaaggaatatctgtgcttcctgatgtgtgtgcttgagatttgggctctatatccagcatttgaactcacattctcagtggcagagtcatggtctgtggcaccatttcaaggccaaaaatcccatccaatttcccttcacatagatgacagaaaagcaagaaagtagctgccttaactcgaacagttctgggaaaaaaactgggggccttgtcctgaggctgtggagacttaattcttcagctgggtggttcccgtaggaacaaggaacactttagctacttcttactcttttaacaccaatggctgtgggagaaggaaaggctcaaggccagggctcagctcgcagagtccatcttctcccacagttgccacatttgagagggggcctgctgaatgcccttgctgtcccctatggcagtattgaggcctgaccgaagtctggtatgctgcttgctggctacaagaactggtcacaggatgaaaattggggaaaggatttgggggaggtgacaagggtggcatggaagtctaggggacaaagggacagggttgggaacaaattggttaactttgattgccactcactgtggtgctttccccctttcccttgaattctgctttgaaaagaataaatttgtacttgttta

SEQ ID NO: 128824 - DNA, 7018 bp, Homo sapiens
  Payload ID: 5194
  Gene Symbol: DRP2
  Gene Name: dystrophin related protein 2
  Uniprot ID: Q13474
  ENST ID: ENST00000402866
  CDS Start-End: 269-3142
tgcttctcaggctcttccgctttcctcctctgcttctaatgaattgacatctccaagagccgccacatctctggtagttttacaaaactgtccttgctcttcctgcgtttgcccagtcaagggtatttttgcctgagaggcagcccagccccggcctcccagcttacagctgccgcctgcttctcagacctgacggaatcagaaggtgcttaatgatcaatagttggtgcactgcctatcctcatcccccccatgagccttggtttttatgcaacctatggtcatgcagggatgcccttacaccctcccacgatgtcatgactggcaggcagctgaccagttccatcatagcagcagcctccgaagcacctgcccccaccctcaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccgcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggcctttatggaagaagtcaagtctcggggcccctacatctattctgtgctggagtcagctcaggccttcctgtcccagcacccatttgaggagttagaggagcctcattctgagagcaaagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctgagccaagctgagggagtccgagccacttgggagcccattggggatctcttcattgattcactcccagagcacatccaggctattaagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggcgtcagttagtgagaggcttaagcagctccaggatgcccaccgggactttgggcctgggtcacagcactttctctcctcctctgtccaggttccctgggaaagagcaatttcacccaataaagttccctactacatcaaccaccaggctcagaccacatgctgggaccatcccaagatgacagagttataccaaaccctagctgatctgaacaacattaagttctcagcttatcgcactgccatgaaactccgcagagtccagaaagccctgcgcttggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaacgtgccactctgtgtggacatgagcctcaattggctcctcaatgtttttgatagtggtcgcagcggaaagatgcgggcattgtcttttaagactggcattgcatgcttgtgtggcacggaagtgaaggaaaaacttcagtacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtaccggagtctgaagcaattcaacgttgacatctgccagacctgcttcttgacaggcagggccagcaaaggcaataagctgcactaccccatcatggagtattacacaccgaccacatccagtgagaacatgagggactttgccacaaccttaaagaacaaattccgctccaagcattatttcagcaaacaccctcagcgaggttatctgcctgtgcaatcagtgctggaggctgactacagtgagacgccggcttcttccccgatgtggccacacgccgacacacactcccgaattgagcattttgccagcaggcttgctgagatggaaagtcaaaattgctccttctttaatgacagcttgtccccagatgacagcatagacgaggaccagtacctgctgcggcactccagccccatcacagaccgggagccagcctttggacagcaggctccatgcagtgtggccacagaaagcaaaggggagctacagaagatcctggcccacttggaagatgagaaccggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcagccacccaccgaatcagatggcagtggctctgcaggctcgtccctagcttcctctccacagcagtcagaaggcagtcacccccgggagaagggacagactactccagataccgaggctgcagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagacaccttccccaccccaagtgcccctgaaaaagtctgggcagtgtgtgttctattacttcagctccaggacagattgctagccatcctaatgctacctaggtattggtttctcctcaaatatcttcattttctttagcctcagtccctgacagaccttccttaaggggagaacagttcattctggttcttctacgttatatttggaagcattaaatccatacttatgggtttagattttttttttgccccacatcttcctatttcttaaagtcctcagcattttgagagacccactgagttgcgagttgctctggaaacctggctgaagccaccctttgctcctctgagtctgtcctcacagacctgaggacacagtggcagcttgctgagcaagggagtgttgctttccttgggtaaggaagaggaagcccacctcaagtctggagtagtatgactgccatccaacacccttccaggctgtgacccttctagctctcaggctgaatcaggtgaggtggctgattgtccccagctaatcataaggcatttgcaactggctaccgtgtgtagtggcccctccataggagccacaggccacaaatcaggaagctggccactttccacccagacaacaacagcaaggccttcctgtgcctaaaattgttatttctaactctggaaggtgaatccaatcctcaaactgaactagctcttcctaggcgacatataccatgatctctttatccagaaactgttcagaatagatagtaggggtgggggagtgggcttgggaatgttgaatagattcagagcccacttaggcagctttctcccaagaggagctttataacctagagccctgcagttgacttcatttgcctaagtttatatacatacatatctattctacatatctactgtacatcagtgctctcctggcctcactcacacattaaattctaatacctcttgaagtattaatgttctgccttgctctttgttagccccagcctctggttggaaagatagatgtatcctggctgttcccctaggatatctctctccattgatgtttggggtgggctgtcctcaagaccaaagcaacagaaacctgtggtcacagagaatctaacaggaagagtcactgttctcttcactcattccaaatcttgttcccttgagacctgggccttgggtgaattttcctgggctcccctaaatggttcaggtgccaaaatagagcaaacccaagctctgcccaccccatgcagaaaaggacaaacaggcctttattagcctttgccagctaagacacagagaacattctctggtcccttccagctcttatggtctcactcagggctaaagaaagcaacagttgccaccacaatcaggagggagtgacggttggggtgttgtattataatccagcagtgggccagtgggtagaactgctaggaacctagtttgatctgctgcaggggaggcagggcagtggcttgggtccagaagcttagggttgcctcctccaccactaagtcacaggtccagggtgtcagacttcacagcataacatctgccttagtgttcatgaggtctctgggcaggagaactgggtatctggatagatggttgagcaggtggtaggcgggcatcaatcatagaacctgggcatcagtcagagtgggagcatatttgtagaagcctagattgtgggcgggaatgtgggacggagggctcaaggactttggaggcatatgcctgcctaagccttaggcgggtacatgttatggagcaattttttaccaggaaagtcctggaaaatcttttctgttatccccaccccacctgagagctcttgggctgctgagggcctgtggcaactgcagtgggccaggcatggtagaaaagatgtagatcttgttatgtaggatttgcgttgtaggtggactgaagcagcaggtcaagagttgaattctcactaaggggtcactgacattttgtggtcctgtgtttaccttaatgcctaaggtgagtgtattgttcaagggtccagggacagtcactgcagtatgtgtggggaattttcccacagtaaggtaaatggatccttgggtactatgaatccaacttggggttggatttaccaaaatgtgttgtatgttgttagacatcttgttgtgtattagtcttctaaggatattgtgcatggcactgtgtagtttatagccctacactggaaggatggtgaagggagttgctagattgatagcctaaagaaaaccttctgactgtgggattagcatcaatgataaggaatgtgagcatttgctggggttgttgtcaaatagtatcagagaacagttaggactgagaggtgatttcttcttgacagaatttgatagaggccaaaaagccattacgaggatacctctgcttccagtgacagcagagtggattcacattgattgggcattgtcacggaaggctgactagctggaggacatcaggctgtgctatgcttccctagggaggacatgtgcccttccctccagattagaaaggctagaatcaagagtttcaagtgctcattttcttcaaggtccaaggttgggaactatttccctacagagaaatctgtttgagtttctggtgctccaggaaatgggttggcaggacacagaaatgagaaaccctgaggccaggaagaggccaatcctaggagatgttttccctccagattcattttaaggaatatctgtgcttcctgatgtgtgtgcttgagatttgggctctatatccagcatttgaactcacattctcagtggcagagtcatggtctgtggcaccatttcaaggccaaaaatcccatccaatttcccttcacatagatgacagaaaagcaagaaagtagctgccttaactcgaacagttctgggaaaaaaactgggggccttgtcctgaggctgtggagacttaattcttcagctgggtggttcccgtaggaacaaggaacactttagctacttcttactcttttaacaccaatggctgtgggagaaggaaaggctcaaggccagggctcagctcgcagagtccatcttctcccacagttgccacatttgagagggggcctgctgaatgcccttgctgtcccctatggcagtattgaggcctgaccgaagtctggtatgctgcttgctggctacaagaactggtcacaggatgaaaattggggaaaggatttgggggaggtgacaagggtggcatggaagtctaggggacaaagggacagggttgggaacaaattggttaactttgattgccactcactgtggtgctttccccctttcccttgaattctgctttgaaaagaataaatttgtacttgttta

SEQ ID NO: 128825 - DNA, 6852 bp, Homo sapiens
  Payload ID: 5194
  Gene Symbol: DRP2
  Gene Name: dystrophin related protein 2
  Uniprot ID: Q13474
  ENST ID: ENST00000538510
  CDS Start-End: 104-2977
ctaggtcttgactcgaaatctctctgtattgcttttccaggtgcttaatgatcaatagttggtgcactgcctatcctcatcccccccatgagccttggtttttatgcaacctatggtcatgcagggatgcccttacaccctcccacgatgtcatgactggcaggcagctgaccagttccatcatagcagcagcctccgaagcacctgcccccaccctcaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccgcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggcctttatggaagaagtcaagtctcggggcccctacatctattctgtgctggagtcagctcaggccttcctgtcccagcacccatttgaggagttagaggagcctcattctgagagcaaagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctgagccaagctgagggagtccgagccacttgggagcccattggggatctcttcattgattcactcccagagcacatccaggctattaagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggcgtcagttagtgagaggcttaagcagctccaggatgcccaccgggactttgggcctgggtcacagcactttctctcctcctctgtccaggttccctgggaaagagcaatttcacccaataaagttccctactacatcaaccaccaggctcagaccacatgctgggaccatcccaagatgacagagttataccaaaccctagctgatctgaacaacattaagttctcagcttatcgcactgccatgaaactccgcagagtccagaaagccctgcgcttggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaacgtgccactctgtgtggacatgagcctcaattggctcctcaatgtttttgatagtggtcgcagcggaaagatgcgggcattgtcttttaagactggcattgcatgcttgtgtggcacggaagtgaaggaaaaacttcagtacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtaccggagtctgaagcaattcaacgttgacatctgccagacctgcttcttgacaggcagggccagcaaaggcaataagctgcactaccccatcatggagtattacacaccgaccacatccagtgagaacatgagggactttgccacaaccttaaagaacaaattccgctccaagcattatttcagcaaacaccctcagcgaggttatctgcctgtgcaatcagtgctggaggctgactacagtgagacgccggcttcttccccgatgtggccacacgccgacacacactcccgaattgagcattttgccagcaggcttgctgagatggaaagtcaaaattgctccttctttaatgacagcttgtccccagatgacagcatagacgaggaccagtacctgctgcggcactccagccccatcacagaccgggagccagcctttggacagcaggctccatgcagtgtggccacagaaagcaaaggggagctacagaagatcctggcccacttggaagatgagaaccggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcagccacccaccgaatcagatggcagtggctctgcaggctcgtccctagcttcctctccacagcagtcagaaggcagtcacccccgggagaagggacagactactccagataccgaggctgcagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagacaccttccccaccccaagtgcccctgaaaaagtctgggcagtgtgtgttctattacttcagctccaggacagattgctagccatcctaatgctacctaggtattggtttctcctcaaatatcttcattttctttagcctcagtccctgacagaccttccttaaggggagaacagttcattctggttcttctacgttatatttggaagcattaaatccatacttatgggtttagattttttttttgccccacatcttcctatttcttaaagtcctcagcattttgagagacccactgagttgcgagttgctctggaaacctggctgaagccaccctttgctcctctgagtctgtcctcacagacctgaggacacagtggcagcttgctgagcaagggagtgttgctttccttgggtaaggaagaggaagcccacctcaagtctggagtagtatgactgccatccaacacccttccaggctgtgacccttctagctctcaggctgaatcaggtgaggtggctgattgtccccagctaatcataaggcatttgcaactggctaccgtgtgtagtggcccctccataggagccacaggccacaaatcaggaagctggccactttccacccagacaacaacagcaaggccttcctgtgcctaaaattgttatttctaactctggaaggtgaatccaatcctcaaactgaactagctcttcctaggcgacatataccatgatctctttatccagaaactgttcagaatagatagtaggggtgggggagtgggcttgggaatgttgaatagattcagagcccacttaggcagctttctcccaagaggagctttataacctagagccctgcagttgacttcatttgcctaagtttatatacatacatatctattctacatatctactgtacatcagtgctctcctggcctcactcacacattaaattctaatacctcttgaagtattaatgttctgccttgctctttgttagccccagcctctggttggaaagatagatgtatcctggctgttcccctaggatatctctctccattgatgtttggggtgggctgtcctcaagaccaaagcaacagaaacctgtggtcacagagaatctaacaggaagagtcactgttctcttcactcattccaaatcttgttcccttgagacctgggccttgggtgaattttcctgggctcccctaaatggttcaggtgccaaaatagagcaaacccaagctctgcccaccccatgcagaaaaggacaaacaggcctttattagcctttgccagctaagacacagagaacattctctggtcccttccagctcttatggtctcactcagggctaaagaaagcaacagttgccaccacaatcaggagggagtgacggttggggtgttgtattataatccagcagtgggccagtgggtagaactgctaggaacctagtttgatctgctgcaggggaggcagggcagtggcttgggtccagaagcttagggttgcctcctccaccactaagtcacaggtccagggtgtcagacttcacagcataacatctgccttagtgttcatgaggtctctgggcaggagaactgggtatctggatagatggttgagcaggtggtaggcgggcatcaatcatagaacctgggcatcagtcagagtgggagcatatttgtagaagcctagattgtgggcgggaatgtgggacggagggctcaaggactttggaggcatatgcctgcctaagccttaggcgggtacatgttatggagcaattttttaccaggaaagtcctggaaaatcttttctgttatccccaccccacctgagagctcttgggctgctgagggcctgtggcaactgcagtgggccaggcatggtagaaaagatgtagatcttgttatgtaggatttgcgttgtaggtggactgaagcagcaggtcaagagttgaattctcactaaggggtcactgacattttgtggtcctgtgtttaccttaatgcctaaggtgagtgtattgttcaagggtccagggacagtcactgcagtatgtgtggggaattttcccacagtaaggtaaatggatccttgggtactatgaatccaacttggggttggatttaccaaaatgtgttgtatgttgttagacatcttgttgtgtattagtcttctaaggatattgtgcatggcactgtgtagtttatagccctacactggaaggatggtgaagggagttgctagattgatagcctaaagaaaaccttctgactgtgggattagcatcaatgataaggaatgtgagcatttgctggggttgttgtcaaatagtatcagagaacagttaggactgagaggtgatttcttcttgacagaatttgatagaggccaaaaagccattacgaggatacctctgcttccagtgacagcagagtggattcacattgattgggcattgtcacggaaggctgactagctggaggacatcaggctgtgctatgcttccctagggaggacatgtgcccttccctccagattagaaaggctagaatcaagagtttcaagtgctcattttcttcaaggtccaaggttgggaactatttccctacagagaaatctgtttgagtttctggtgctccaggaaatgggttggcaggacacagaaatgagaaaccctgaggccaggaagaggccaatcctaggagatgttttccctccagattcattttaaggaatatctgtgcttcctgatgtgtgtgcttgagatttgggctctatatccagcatttgaactcacattctcagtggcagagtcatggtctgtggcaccatttcaaggccaaaaatcccatccaatttcccttcacatagatgacagaaaagcaagaaagtagctgccttaactcgaacagttctgggaaaaaaactgggggccttgtcctgaggctgtggagacttaattcttcagctgggtggttcccgtaggaacaaggaacactttagctacttcttactcttttaacaccaatggctgtgggagaaggaaaggctcaaggccagggctcagctcgcagagtccatcttctcccacagttgccacatttgagagggggcctgctgaatgcccttgctgtcccctatggcagtattgaggcctgaccgaagtctggtatgctgcttgctggctacaagaactggtcacaggatgaaaattggggaaaggatttgggggaggtgacaagggtggcatggaagtctaggggacaaagggacagggttgggaacaaattggttaactttgattgccactcactgtggtgctttccccctttcccttgaattctgctttgaaaagaataaatttgtacttgttt

SEQ ID NO: 128826 - DNA, 6835 bp, Homo sapiens
  Payload ID: 5194
  Gene Symbol: DRP2
  Gene Name: dystrophin related protein 2
  Uniprot ID: Q13474
  ENST ID: ENST00000541709
  CDS Start-End: 321-2960
tagcaacacagagcagctctgagaggggaggaggaggagaagaaggaagacagggaagtgggagagacagagggagagtgtgcatacagcagctgtcggcatccctgtctcagggacttctttgctgattcacagaggcagcccagccccggcctcccagcttacagctgccgcctgcttctcagacctgacggaatcagaaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccgcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggcctttatggaagaagtcaagtctcggggcccctacatctattctgtgctggagtcagctcaggccttcctgtcccagcacccatttgaggagttagaggagcctcattctgagagcaaagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctgagccaagctgagggagtccgagccacttgggagcccattggggatctcttcattgattcactcccagagcacatccaggctattaagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggcgtcagttagtgagaggcttaagcagctccaggatgcccaccgggactttgggcctgggtcacagcactttctctcctcctctgtccaggttccctgggaaagagcaatttcacccaataaagttccctactacatcaaccaccaggctcagaccacatgctgggaccatcccaagatgacagagttataccaaaccctagctgatctgaacaacattaagttctcagcttatcgcactgccatgaaactccgcagagtccagaaagccctgcgcttggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaacgtgccactctgtgtggacatgagcctcaattggctcctcaatgtttttgatagtggtcgcagcggaaagatgcgggcattgtcttttaagactggcattgcatgcttgtgtggcacggaagtgaaggaaaaacttcagtacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtaccggagtctgaagcaattcaacgttgacatctgccagacctgcttcttgacaggcagggccagcaaaggcaataagctgcactaccccatcatggagtattacacaccgaccacatccagtgagaacatgagggactttgccacaaccttaaagaacaaattccgctccaagcattatttcagcaaacaccctcagcgaggttatctgcctgtgcaatcagtgctggaggctgactacagtgagacgccggcttcttccccgatgtggccacacgccgacacacactcccgaattgagcattttgccagcaggcttgctgagatggaaagtcaaaattgctccttctttaatgacagcttgtccccagatgacagcatagacgaggaccagtacctgctgcggcactccagccccatcacagaccgggagccagcctttggacagcaggctccatgcagtgtggccacagaaagcaaaggggagctacagaagatcctggcccacttggaagatgagaaccggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcagccacccaccgaatcagatggcagtggctctgcaggctcgtccctagcttcctctccacagcagtcagaaggcagtcacccccgggagaagggacagactactccagataccgaggctgcagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagacaccttccccaccccaagtgcccctgaaaaagtctgggcagtgtgtgttctattacttcagctccaggacagattgctagccatcctaatgctacctaggtattggtttctcctcaaatatcttcattttctttagcctcagtccctgacagaccttccttaaggggagaacagttcattctggttcttctacgttatatttggaagcattaaatccatacttatgggtttagattttttttttgccccacatcttcctatttcttaaagtcctcagcattttgagagacccactgagttgcgagttgctctggaaacctggctgaagccaccctttgctcctctgagtctgtcctcacagacctgaggacacagtggcagcttgctgagcaagggagtgttgctttccttgggtaaggaagaggaagcccacctcaagtctggagtagtatgactgccatccaacacccttccaggctgtgacccttctagctctcaggctgaatcaggtgaggtggctgattgtccccagctaatcataaggcatttgcaactggctaccgtgtgtagtggcccctccataggagccacaggccacaaatcaggaagctggccactttccacccagacaacaacagcaaggccttcctgtgcctaaaattgttatttctaactctggaaggtgaatccaatcctcaaactgaactagctcttcctaggcgacatataccatgatctctttatccagaaactgttcagaatagatagtaggggtgggggagtgggcttgggaatgttgaatagattcagagcccacttaggcagctttctcccaagaggagctttataacctagagccctgcagttgacttcatttgcctaagtttatatacatacatatctattctacatatctactgtacatcagtgctctcctggcctcactcacacattaaattctaatacctcttgaagtattaatgttctgccttgctctttgttagccccagcctctggttggaaagatagatgtatcctggctgttcccctaggatatctctctccattgatgtttggggtgggctgtcctcaagaccaaagcaacagaaacctgtggtcacagagaatctaacaggaagagtcactgttctcttcactcattccaaatcttgttcccttgagacctgggccttgggtgaattttcctgggctcccctaaatggttcaggtgccaaaatagagcaaacccaagctctgcccaccccatgcagaaaaggacaaacaggcctttattagcctttgccagctaagacacagagaacattctctggtcccttccagctcttatggtctcactcagggctaaagaaagcaacagttgccaccacaatcaggagggagtgacggttggggtgttgtattataatccagcagtgggccagtgggtagaactgctaggaacctagtttgatctgctgcaggggaggcagggcagtggcttgggtccagaagcttagggttgcctcctccaccactaagtcacaggtccagggtgtcagacttcacagcataacatctgccttagtgttcatgaggtctctgggcaggagaactgggtatctggatagatggttgagcaggtggtaggcgggcatcaatcatagaacctgggcatcagtcagagtgggagcatatttgtagaagcctagattgtgggcgggaatgtgggacggagggctcaaggactttggaggcatatgcctgcctaagccttaggcgggtacatgttatggagcaattttttaccaggaaagtcctggaaaatcttttctgttatccccaccccacctgagagctcttgggctgctgagggcctgtggcaactgcagtgggccaggcatggtagaaaagatgtagatcttgttatgtaggatttgcgttgtaggtggactgaagcagcaggtcaagagttgaattctcactaaggggtcactgacattttgtggtcctgtgtttaccttaatgcctaaggtgagtgtattgttcaagggtccagggacagtcactgcagtatgtgtggggaattttcccacagtaaggtaaatggatccttgggtactatgaatccaacttggggttggatttaccaaaatgtgttgtatgttgttagacatcttgttgtgtattagtcttctaaggatattgtgcatggcactgtgtagtttatagccctacactggaaggatggtgaagggagttgctagattgatagcctaaagaaaaccttctgactgtgggattagcatcaatgataaggaatgtgagcatttgctggggttgttgtcaaatagtatcagagaacagttaggactgagaggtgatttcttcttgacagaatttgatagaggccaaaaagccattacgaggatacctctgcttccagtgacagcagagtggattcacattgattgggcattgtcacggaaggctgactagctggaggacatcaggctgtgctatgcttccctagggaggacatgtgcccttccctccagattagaaaggctagaatcaagagtttcaagtgctcattttcttcaaggtccaaggttgggaactatttccctacagagaaatctgtttgagtttctggtgctccaggaaatgggttggcaggacacagaaatgagaaaccctgaggccaggaagaggccaatcctaggagatgttttccctccagattcattttaaggaatatctgtgcttcctgatgtgtgtgcttgagatttgggctctatatccagcatttgaactcacattctcagtggcagagtcatggtctgtggcaccatttcaaggccaaaaatcccatccaatttcccttcacatagatgacagaaaagcaagaaagtagctgccttaactcgaacagttctgggaaaaaaactgggggccttgtcctgaggctgtggagacttaattcttcagctgggtggttcccgtaggaacaaggaacactttagctacttcttactcttttaacaccaatggctgtgggagaaggaaaggctcaaggccagggctcagctcgcagagtccatcttctcccacagttgccacatttgagagggggcctgctgaatgcccttgctgtcccctatggcagtattgaggcctgaccgaagtctggtatgctgcttgctggctacaagaactggtcacaggatgaaaattggggaaaggatttgggggaggtgacaagggtggcatggaagtctaggggacaaagggacagggttgggaacaaattggttaactttgattgccactcactgtggtgctttccccctttcccttgaattctgctttgaaaagaataaatttgtacttgttt

SEQ ID NO: 128827 - DNA, 2051 bp, Homo sapiens
  Payload ID: 5195
  Gene Symbol: DYTN
  Gene Name: dystrotelin
  Uniprot ID: A2CJ06
  ENST ID: ENST00000452335
  CDS Start-End: 118-1854
ttgcctttttgttcccctgtcctcattcctctgctgcaaaaccttctgcttaaaatactggttcatttctagttacagggacccacttgccatctgtcattccaggaaatttgtgaaatggatccagataaacaagatgctcttaatagtattgagaattccatttatagaacagccttcaaattacaatcagtgcaaactctgtgccagttggacttgattgacagctccctgattcagcaggtcctactgcgtccaagtttctgggaagctcgcaagcactccctttctgtgcagcaactttctcaggcactccaagagctgtttcagaaggccagggaggaaaacccaggacaagtgcatcccagagctccggaactcactctgagccttctcacgacaatgtacaacagcaaaggaacaggttttctccagcttatgcctgcggccgctgccctaataaccctctcaggagacagccctctttcaaaataccgagctctttttcaactctatgcagaaaatagcaggggaggctatgattctgggccacgcatgactcgaagggttttgagaaaactactaacagatctacagcagatcccaactttcgtgggagagagtcgtgctctgtgccctgtggaaagtgccacccgcagctgtttccaaggggtgttgagcccagcaatcaaagaagaaaaattcctgtcttgggtccaatctgagcctcccatcctcctgtggctcccgacctgccaccggttatcagctgctgaaagggtcactcaccctgctcggtgcactctctgcaggactttcccaatcacgggactcagataccgctgtctgaagtgtctcaactttgacatctgccagatgtgtttcttatctggtcttcacagcaagtcccatcagaagtctcatcctgtcattgagcactgcattcagatgtcagcaatgcagaatacaaaacttctcttcaggaccctcagaaacaaccttcttcaggggcgctgtaggaagaaagaagcagcgagaaggcagcagctgctggaccaggtgaatccaaagggtgtgcctcaccatgcgcaggccaggctccttaaaaaacagttaaaccaatacaaagacaagttgcaagctatatacacctcccaggaagaaagaatttgtcgatttgaaacaaggattcacaaactcaaaaccaaccaggatagtctatggaccaagctacaacagataagacgggacctacaggcaaggttgcagccacccggtccttcatcttcttcctttcaaaatgtggggaacaaggttgaccattcttcaactgaaaaggttccaaagggaggggattatttgcagatcaagaatgccactgaagatgcttcaacaggggaacctcttcctaagcttgatgaggttgacagaagtcacagaagtcacacaaatgcagagcatgctctgcgaaatccagaatcaccagagaccactttgcacagcaccagggcacaaagccaaacacaaaagatgccacagaaagtcattagtgccctacccagttatcaggagggactgaagcaggacatccccaaaatggttcctgctgaaatgagcagtcctgctctggcagccgtggaaaagaaagaggcaggtaacatcaaggagagaaaggatgagctggaggaagaggaactgcaagaactattgtcaaaacttatggatgccttcaatctagaaacgccatcaggcccggagtcttcagtaaacatggacctgtacagtggagctcagcgagtgtgcagggccttctctgcccttgttgatcaaattgccttgcccaatttgaagtgaaatggagtccaggctcaaaggcctcttggtgtgatgacaaaatgcagttgcacaactgtattaaaagaattaagacttctacctttcttttaatagtttagtgtgaactatgaagaaaacaggttttgttttttgatctccctccctacttatgtatcttagttctgcagttcagagtgaaggttgggggttagcag

SEQ ID NO: 128828 - DNA, 9587 bp, Homo sapiens
  Payload ID: 5196
  Gene Symbol: EP300
  Gene Name: E1A binding protein p300
  Uniprot ID: Q09472
  ENST ID: ENST00000263253
  CDS Start-End: 1220-8464
cttgtttgtgtgctaggctgggggggagagagggcgagagagagcgggcgagagtgggcaagcaggacgccgggctgagtgctaactgcgggagccagagagtgcggaggggagtcgggtcggagagaggcggcaggggccgagacagtggcagggggcccggggcgcacgggctgaggcgacccccagccccctcccgtccgcacacacccccaccgcggtccagcagccgggccggcgtcgacgcctaggggggaccattacataaccccgcgccccgcggcgtcttctcccgccgccgcgggcggccccgaacggagccccggggggcgggcgctcccagcacctggccgccggcggtgggggccgtagcagcggccgtatttatttattttccgcgggaaaggaaggcgaaggaggggagcgcggcgcgaggaggggccgcctgcgccgccgccggagcggggcctcctcggtgggctccgcgtcggcgcgggcgtgcgggcggcgctgctcggcccggccccctcggccctctggtccggccagctccgctcccggcgtccttgccgcgcctccgccggccgccgcgcgatgtgaggcggcggcgccagcctggctctcggctcgggcgagttctctgcggccattaggggccggtgcggcggcggcggcgcggagcgcggcggcaggaggagggttcggagggtgggggcgcaggcccgggagggggcaccgggaggaggtgagtgtctcttgtcgcctcctcctctccccccttttcgcccccgcctccttgtggcgatgagaaggaggaggacagcgccgaggaggaagaggttgatggcggcggcggagctccgagagacctcggctgggcaggggccggccgtggcgggccggggactgcgcctctagagccgcgagttctcgggaattcgccgcagcggacgcgctcggcgaatttgtgctcttgtgccctcctccgggcttgggcccaggcccggcccctcgcacttgcccttaccttttctatcgagtccgcatccctctccagccactgcgacccggcgaagagaaaaaggaacttcccccaccccctcgggtgccgtcggagccccccagcccacccctgggtgcggcgcggggaccccgggccgaagaagagatttcctgaggattctggttttcctcgcttgtatctccgaaagaattaaaaatggccgagaatgtggtggaaccggggccgccttcagccaagcggcctaaactctcatctccggccctctcggcgtccgccagcgatggcacagattttggctctctatttgacttggagcacgacttaccagatgaattaatcaactctacagaattgggactaaccaatggtggtgatattaatcagcttcagacaagtcttggcatggtacaagatgcagcttctaaacataaacagctgtcagaattgctgcgatctggtagttcccctaacctcaatatgggagttggtggcccaggtcaagtcatggccagccaggcccaacagagcagtcctggattaggtttgataaatagcatggtcaaaagcccaatgacacaggcaggcttgacttctcccaacatggggatgggcactagtggaccaaatcagggtcctacgcagtcaacaggtatgatgaacagtccagtaaatcagcctgccatgggaatgaacacagggatgaatgcgggcatgaatcctggaatgttggctgcaggcaatggacaagggataatgcctaatcaagtcatgaacggttcaattggagcaggccgagggcgacagaatatgcagtacccaaacccaggcatgggaagtgctggcaacttactgactgagcctcttcagcagggctctccccagatgggaggacaaacaggattgagaggcccccagcctcttaagatgggaatgatgaacaaccccaatccttatggttcaccatatactcagaatcctggacagcagattggagccagtggccttggtctccagattcagacaaaaactgtactatcaaataacttatctccatttgctatggacaaaaaggcagttcctggtggaggaatgcccaacatgggtcaacagccagccccgcaggtccagcagccaggcctggtgactccagttgcccaagggatgggttctggagcacatacagctgatccagagaagcgcaagctcatccagcagcagcttgttctccttttgcatgctcacaagtgccagcgccgggaacaggccaatggggaagtgaggcagtgcaaccttccccactgtcgcacaatgaagaatgtcctaaaccacatgacacactgccagtcaggcaagtcttgccaagtggcacactgtgcatcttctcgacaaatcatttcacactggaagaattgtacaagacatgattgtcctgtgtgtctccccctcaaaaatgctggtgataagagaaatcaacagccaattttgactggagcacccgttggacttggaaatcctagctctctaggggtgggtcaacagtctgcccccaacctaagcactgttagtcagattgatcccagctccatagaaagagcctatgcagctcttggactaccctatcaagtaaatcagatgccgacacaaccccaggtgcaagcaaagaaccagcagaatcagcagcctgggcagtctccccaaggcatgcggcccatgagcaacatgagtgctagtcctatgggagtaaatggaggtgtaggagttcaaacgccgagtcttctttctgactcaatgttgcattcagccataaattctcaaaacccaatgatgagtgaaaatgccagtgtgccctccctgggtcctatgccaacagcagctcaaccatccactactggaattcggaaacagtggcacgaagatattactcaggatcttcgaaatcatcttgttcacaaactcgtccaagccatatttcctacgccggatcctgctgctttaaaagacagacggatggaaaacctagttgcatatgctcggaaagttgaaggggacatgtatgaatctgcaaacaatcgagcggaatactaccaccttctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctaatggccctctacctgacccaagtatgatccgtggcagtgtgccaaaccagatgatgcctcgaataactccacaatctggtttgaatcaatttggccagatgagcatggcccagccccctattgtaccccggcaaacccctcctcttcagcaccatggacagttggctcaacctggagctctcaacccgcctatgggctatgggcctcgtatgcaacagccttccaaccagggccagttccttcctcagactcagttcccatcacagggaatgaatgtaacaaatatccctttggctccgtccagcggtcaagctccagtgtctcaagcacaaatgtctagttcttcctgcccggtgaactctcctataatgcctccagggtctcaggggagccacattcactgtccccagcttcctcaaccagctcttcatcagaattcaccctcgcctgtacctagtcgtacccccacccctcaccatactcccccaagcataggggctcagcagccaccagcaacaacaattccagcccctgttcctacacctcctgccatgccacctgggccacagtcccaggctctacatccccctccaaggcagacacctacaccaccaacaacacaacttccccaacaagtgcagccttcacttcctgctgcaccttctgctgaccagccccagcagcagcctcgctcacagcagagcacagcagcgtctgttcctaccccaacagcaccgctgcttcctccgcagcctgcaactccactttcccagccagctgtaagcattgaaggacaggtatcaaatcctccatctactagtagcacagaagtgaattctcaggccattgctgagaagcagccttcccaggaagtgaagatggaggccaaaatggaagtggatcaaccagaaccagcagatactcagccggaggatatttcagagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagattttcaaaccagaagaactacgacaggcactgatgccaactttggaggcactttaccgtcaggatccagaatcccttccctttcgtcaacctgtggaccctcagcttttaggaatccctgattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaagttggagttctctccacagacactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggagagtatacatatcttacctcgatagtgttcatttcttccgtcctaaatgcttgaggactgcagtctatcatgaaatcctaattggatatttagaatatgtcaagaaattaggttacacaacagggcatatttgggcatgtccaccaagtgagggagatgattatatcttccattgccatcctcctgaccagaagatacccaagcccaagcgactgcaggaatggtacaaaaaaatgcttgacaaggctgtatcagagcgtattgtccatgactacaaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtgaccaagggagacagcaaaaatgctaaaaagaagaataataagaaaaccagcaaaaataagagcagcctgagtaggggcaacaagaagaaacccgggatgcccaatgtatctaacgacctctcacagaaactatatgccaccatggagaagcataaagaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccactcacacacacacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacacc

SEQ ID NO: 128829 - DNA, 401 bp, Homo sapiens
  Payload ID: 5196
  Gene Symbol: EP300
  Gene Name: E1A binding protein p300
  ENST ID: ENST00000634728
  CDS Start-End: 1-401
gcggaatactaccaccttctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctagtttgaatcaatttggccagatgagcatggcccagccccctattgtaccccggcaaacccctcctcttcagcaccatggacagttggctcaacctggagctctcaacccgcctatgggctatgggcctcgtatgcaacagccttccaaccagggccagttccttcctcagactcagttcccatcacagggaatgaatgtaacaaatatccctttggctccgtccag

SEQ ID NO: 128830 - DNA, 559 bp, Homo sapiens
  Payload ID: 5196
  Gene Symbol: EP300
  Gene Name: E1A binding protein p300
  ENST ID: ENST00000634690
  CDS Start-End: 1-559
agtaaatcagatgccgacacaaccccaggtgcaagcaaagaaccagcagaatcagcagcctgggcagtctccccaaggcatgcggcccatgagcaacatgagtgctagtcctatgggagtaaatggaggtgtaggagttcaaacgccgagtcttctttctgactcaatgttgcattcagccataaattctcaaaacgtccaagccatatttcctacgccggatcctgctgctttaaaagacagacggatggaaaacctagttgcatatgctcggaaagttgaaggggacatgtatgaatctgcaaacaatcgagcggaatactaccaccttctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctaatggccctctacctgacccaagtatgatccgtggcagtgtgccaaaccagatgatgcctcgaataactcca

SEQ ID NO: 128831 - DNA, 3908 bp, Homo sapiens
  Payload ID: 5197
  Gene Symbol: EP400
  Gene Name: E1A binding protein p400
  ENST ID: ENST00000330386
  CDS Start-End: 1-1124
agcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccaacagcccaagtgcaagtgcagacctcgcagccgccgcagcagcagagcccccagctcacgacggtcacggccccaaggcctggtgccctgctgacgggcaccaccgtggccaacctccaggtggcccggctcctgcaggcgcaagggcagatgcagacccaggcaccccagccagcccaggtggccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttat

SEQ ID NO: 128832 - DNA, 2588 bp, Homo sapiens
  Payload ID: 5197
  Gene Symbol: EP400
  Gene Name: E1A binding protein p400
  ENST ID: ENST00000332482
  CDS Start-End: 110-2588
cactgagcggctgcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacagggggcttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacacccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaagaagaaacattatgccccattacaagcatatcttaggcagaatgatttggacattgaagaagaggaggaggaggaggaagaggaggaagaaaaatctgaggttatcaatgacgagcaagccctcgcagggagcctggtagcaggggccggaagcacagtagagacggacctgtttaagaggcagcaggcgatgccctccacaggtatggcaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaa

SEQ ID NO: 128833 - DNA, 3092 bp, Homo sapiens
  Payload ID: 5197
  Gene Symbol: EP400
  Gene Name: E1A binding protein p400
  ENST ID: ENST00000333577
  CDS Start-End: 102-3059
ggctgcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacagggggcttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacacccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaagaagaaacattatgccccattacaagcatatcttaggcagaatgatttggacattgaagaagaggaggaggaggaggaagaggaggaagaaaaatctgaggttatcaatgacgaggtaaaggttgtgacaggaaaggatgggcagactgggactcccgttgctatagcaacccagcttccgccaaaggtttctgctgctttttcatcccagcagcaaccatttcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaaggtaggctgttgctaccttattaaacattcagtaagtaaaaagaaacatttaaaaca

SEQ ID NO: 128834 - DNA, 12317 bp, Homo sapiens
  Payload ID: 5197
  Gene Symbol: EP400
  Gene Name: E1A binding protein p400
  Uniprot ID: Q96L91
  ENST ID: ENST00000389561
  CDS Start-End: 153-9524
gtagcagccgcgccgccgcttcctcccgccggggccccggatgcactgagcggctgcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacagggggcttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacacccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaagaagaaacattatgccccattacaagcatatcttaggcagaatgatttggacattgaagaagaggaggaggaggaggaagaggaggaagaaaaatctgaggttatcaatgacgagcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggcctccaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcaacaacagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccaacagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcagctgcaggcgcaagggcagatgcagacccaggcaccccagccagcccaggtggccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttatatatttttt

SEQ ID NO: 128835 - DNA, 12836 bp, Homo sapiens
  Payload ID: 5197
  Gene Symbol: EP400
  Gene Name: E1A binding protein p400
  Uniprot ID: Q96L91
  ENST ID: ENST00000389562
  CDS Start-End: 36-9407
gagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacagggggcttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacacccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaagaagaaacattatgccccattacaagcatatcttaggcagaatgatttggacattgaagaagaggaggaggaggaggaagaggaggaagaaaaatctgaggttatcaatgacgagcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggcctccaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcaacaacagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccaacagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcagctgcaggcgcaagggcagatgcagacccaggcaccccagccagcccaggtggccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttatatattttttcattttgtctttcatagaaaactggtatttaagttaaatgagatgctgaatttttcatttgtgtgaagaaaaaaccaacaagtaatgttggagccagaggtgttcccctcacccactcttccgtggccatagaaggacctggaaggaacagaaatcacattcaccaagtccaccaggcagccgcttcccaaagccgcacgtggaggaaagagctggcaccgccctgccccatgtggcctgccaccctcacagcacccgtcgtcaatgtcctgggggccacactggcaccagtgtccttccacacccagtctgtgtgcccaactggcaccagtgtccttccacacccagtctgtgtgcccaactggcaccagtgtccttccacacccagtctgtgtgcccaactggcaccagtgtccttccacacccagtctgtgtgcccaagtaagggcagggacaccggctcacaggtgctcaccaccgaaaacgcctgtgagcagatggcctgcgagttgttgcttctctttttcttctgcttttagacttttcttcgtttcgttttaaatctgattacaaaaatcaacgtacacttttaattgaaaacgcacacattacgcaaagtaaagaagcatcccagaa

SEQ ID NO: 128836 - DNA, 2503 bp, Homo sapiens
  Payload ID: 5198
  Gene Symbol: E2F1
  Gene Name: E2F transcription factor 1
  Uniprot ID: Q01094
  ENST ID: ENST00000343380
  CDS Start-End: 141-1454
ttggcgcgtaaaagtggccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtgaagcggaggctggacctggaaactgaccatcagtacctggccgagagcagtgggccagctcggggcagaggccgccatccaggaaaaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgcctggcctacgtgacgtgtcaggaccttcgtagcattgcagaccctgcagagcagatggttatggtgatcaaagcccctcctgagacccagctccaagccgtggactcttcggagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtt

SEQ ID NO: 128837 - DNA, 5191 bp, Homo sapiens
  Payload ID: 5199
  Gene Symbol: E2F2
  Gene Name: E2F transcription factor 2
  Uniprot ID: Q14209
  ENST ID: ENST00000361729
  CDS Start-End: 428-1741
aggactagagagcgagccgcaaggaagtcggtgcagtcgagacccccctccccatcccagcgcatcgcgtctccgccgagcttgagggcacgccggggacccctccccagagccggccggaccccaggtgccgaggccttggggagcgcggggcgtcccgggtcgcggtgccctcgggacgagacagcccctggcagtgccaccaccgcagccgccgggcgatctccaagcggcgatctctaagcgctgctctctgctcggccgcgggccaggaggggagggtccggccttgccccgcaggcgtccattggcggcttcccccggcctccgcgccatgccgcgggccgtgtgaaaggcggcagcaccggaacccgcaggtgtccgcgggcgcgccaagcccttttgggtagggggcgccttactcgctatgctgcaagggccccgggccttggcttcggccgctgggcagaccccgaaggtggtgcccgcgatgagccccacagagctgtggccatccggcctcagcagcccccagctctgcccagctactgctacctactacacaccgctgtacccgcagacggcgcctcccgcagcggcgccaggcacctgcctcgacgccactccccacggacccgagggccaagttgtgcgatgcctgccggcaggccggctgccggccaaaaggaagctggatctggaggggattgggaggcccgtcgtccctgagttcccaacccccaaggggaagtgcatcagagtggatggcctccccagccccaaaacccccaaatcccccggggagaagactcggtatgacacttcgctggggctgctcaccaagaagttcatttacctcctgagcgagtcagaggatggggtcctggacctgaactgggccgctgaggtgctggacgtgcagaagcggcgcatctatgacatcaccaacgtgctggaaggcatccagctcatccgcaagaaggccaagaacaacatccagtgggtaggcaggggaatgtttgaagaccccaccagacctgggaagcagcaacagctggggcaggagctgaaggagctgatgaacacggagcaggccttggaccagctcatccagagctgctctctgagcttcaagcacctgactgaggacaaggccaacaagaggctggcctatgtgacttaccaggatatccgtgctgttggcaactttaaggagcagacagtgattgccgtcaaggcccctccgcagacgagactggaagtgcccgacaggactgaggacaacctgcagatatatctcaagagcacccaagggcccatcgaagtctacctgtgcccagaggaggtgcaggagccggacagtccttccgaggagcctctcccctctacctccaccctctgccccagccctgactctgcccagcccagcagcagcaccgaccctagcatcatggagcccacagcatcctcagtgccagcaccagcgccaaccccccagcaggccccaccgcctccatccctggtccccttggaggctactgacagcctgctggagctgccgcacccactcctgcagcagactgaggaccagttcctgtccccgaccctggcgtgcagctcccctctgatcagcttctccccatccttggaccaggacgactacctgtggggcttggaggcgggtgagggcatcagcgatctcttcgactcctacgaccttggggacctgttgattaattgagtggccctgcctgcccccagcagcctgcccccgactctacctcctcacagacaggctgacagcccctctgcctgcacagggacattggacactaggtgctgccctcagggcatggggtctcctcgcctttcctgccccagccggcagaagctgtgtggggagatatgaatggtacgggtgaggagtggataaggggtggtcctcaccttcctaatggaagctgggcctagggaggcccatccagtcttctgacttctgacctctcacaagaaggctgcaggtgaggtggccaagtccagggaaaggccctgctacctccttttgaggggtaattaggaccctcgacgtaccaagaagcacataatgcctttgtatttatttcaggttgagttgtttgtttgtcctccctgagttttagcagggaggttgttctagtttttagtgagacctctgcagacaggcccatcactgtccatgttccagggcaggtctgggtttccaagggaggggcccaggctacatccttggtttccccactgtggtgggggctgggactctgaggggctgtccagtctgctagaatgctaattgcacttaggcctcatggttctagtaaacggcagctgtgggcccttttgcctcttcccctgttcttggcctcacatctccagctgagctgccggtcttggcttcctggtcgcctctgtcccagagatggtcccagggagccatcctagggcaggtagcactgaggctcctgtggaaacaggagccacctgctcaggagacccctttcctgaggaagtccttacctctccccttgagatgtaaaaatggtccagcagagacaagctcccgtggaaaacagacaggagcatgggggcagctgtcatggctgtggcgggcacttttcctcagagtttctgccttgcgctggtccaggagccattttgcaccaaggacttggtaggcagaggcagccccactgtaaagaagggtcagattaaaacaaaaaactgccaaaagcatcccctctgccccccatgtggcactggcatcattctctgcttccctgggaggaattttttcaccatgttattgaaggggatggttcattaaggactccacccctcagagctcactcagaccccaaggacagaggtgactggggcttggtgacttgttcactccttttttcccaggtatactgaaggggtgacagagagaggtcttcatggcagaccaggccttcacagctaatggggagaggaactcatgttacctctgcaggcctggggtcctgagggggtcttttggcttcagcctgttcccccagaggcttgatcatcccacattgtcccttcagctcagctgctcttctcccccacccaccctgggatgtgggtgctctgggctgaaccaaggctatgacttctggagagaggctcaggggttggtctgagaggcctgccatccacccctcagggagctaggttttctcagaggctcagctggacagcactttttagaaaagtttgtagcattaagctggtttaaaatatgaagttggttttgttggatggctcctgagctgactgactgatgtctgaagtttgagacgagggattatttcagggtggggcccaatgtgatctaatgcccagctggggacaattgtgcctcatcatttgctcaaattcctgggcccccaagttagccccctcccaggagtggtcagcgggtcacagctgcccccactctataagcagggctaattgtgtaccctttgcagaaatgcttttggtctcctacccaaatactcacaagggtcttatcagacgcccgtcttaaagtccagcatgctcagggaccctgtgtaggatctcgtttgtggtgagtgggctgctctgaggtctccactgggctgccatttagccatgtgccatctctgaagtcagaggtgtttgactcccattccttgggctctggagctttccccaagaattacatcagagaaaaggaagaaggggcctgcaggacccattgggaatgagtttaatactgaagtctggaatgtaagctcatgccctagaggcctctccatatggctggtcaggggagctgccttcaggcttgtgccccgtgtgctcagcagctgcctctgtccccctctactgtccctttcacaccttgcctggccaaggggctagacctcccaggctaagcctcagattcagtgcaggacacaagctcatgcccccgtcttgccagtgacacttgaagcctcccgacttccacagagtgcttcaggacacattttgagtggtattttcttttctttttttcttctttttttttttttttgagatggagtctcgctctgttgcccaggctggagtgcagtggcctgatctcggctcactgcaacctctgcctcccaggttcaagcgattcttctgcctcagcctccagagtagctgggactatagacatgcaccaccacgcccggctaattttgtatttttggtcgagacggggttttgccatgttagtcaggctggtcttgaactcctgacctcaagtgatccaccacctcggcctcccaaagtgttgagatgacaggcacgagccaccaggcccagcctgagtggtattttctttagggaccaggtagactttaaaacgagggtaagagaaaagccagtgtctttctgaggtaaataatttctgccaggaaacttcccagccccaccagcagcccccctaaaaaaatcactcgtgtccccagggacttctaaagcttggggctccaggaaatcatccagtagagttggagattcagagatttcttgaagccagggacatgctcctaactcctttcccattaaaggtgttagaatagaccagagggtgtcccttttccacagtaatgggatcggctggtgtgccttcagggaggaagagggaggtggtcaagcttgaaaaactggctttaggatggttctgactttgttctccctccccaagtgttctcaacctccattctgcagtgttcagagttttagggaaagggtttgggtgccccagcatccaggtgttgtgtggcttagcgcatgtgaagtgaaaaccttctggggttgtttggaagcagctttctggttcttgtgattgtatcctgaggtcccagaaccctattctcccacgaggatcctcagtgaccatggtggccacacgcctggccagcctgctggctcctgggtgagctgaagaaccttgcctgtggcacttttcgagggtgagctggaaccgagagaacatggtccccgtgctgggactcatgcgggtcatttcctgccggcctggtttcgcctggtcgtgtctttatgagcaccatgtaagcctccttgtattgagataattgggcattaaacattaaactgcagctctggg

SEQ ID NO: 128838 - DNA, 5191 bp, Homo sapiens; identical to SEQ ID NO: 128837
  Payload ID: 5199
  Gene Symbol: E2F2
  Gene Name: E2F transcription factor 2
  ENST ID: ENST00000634683
  CDS Start-End: 428-1741

SEQ ID NO: 128839 - DNA, 4749 bp, Homo sapiens
  Payload ID: 5200
  Gene Symbol: E2F3
  Gene Name: E2F transcription factor 3
  Uniprot ID: O00716
  ENST ID: ENST00000346618
  CDS Start-End: 67-1464
aaataataaagaaattgaaaacaatacattaatataccataacactaaaaagagcaggagcgagagatgagaaagggaatccagcccgctctggagcagtacctggtgaccgccgggggtggggagggggcggctgtcgtcgccgccgccgctgcagcctccatggacaaaagggcactgctagccagccccggcttcgccgccgccgccgccgctgccgccgccccgggcgcgtacatccagatcctcaccacgaacacttccaccacctcctgttcctcctccctccaaagcggcgccgtagccgccggccccctcctccccagtgcccccggcgcggagcagaccgccggcagcctcctctacaccacgccgcacggaccctccagcagagccgggctgctgcagcagccaccagcgctgggacgcggcggcagcggcggcggcggcggccctccggcaaagcgaaggctggagctaggagaaagcggtcatcagtacctctcagatggtttaaaaacccccaagggcaaaggaagagctgcactacgaagtccagatagtccaaaaactccaaaatctccctcagaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatccacctcattaagaagaagtctaaaaacaacgtccaatggatgggctgcagtctgtctgaggatgggggcatgctggcccagtgtcaaggcctgtcaaaagaagtgaccgagctcagtcaggaagagaagaaattagatgaactgatccaaagctgcaccctggacctcaaactgttaaccgaggattcagagaatcaaaggttagcttatgttacatatcaagatattcgaaaaattagtggccttaaagaccaaactgttatagttgtgaaagcccctccagaaacaagacttgaagtgcctgactcaatagagagcctacaaatacatttggcaagtacccaagggcccattgaggtttacttatgtccagaagagactgaaacacacagtccaatgaaaacaaacaaccaagaccacaatgggaatatccctaaacccgcttccaaagacttggcttcaaccaactcaggacatagcgattgctcagtttctatgggaaacctttctcctctggcctccccagccaacctcttacagcagactgaggaccaaattccttccaacctagaaggaccgtttgtgaacttactgcctcccctgctgcaagaggactatctcctgagcctcggggaggaggaaggcatcagcgatctcttcgatgcttacgatttggaaaagctcccactggtggaagacttcatgtgtagttgattatgcttcgtgtgaactctccttaaaaaccgatatttttttatcatggaaccagaacatctgtcatgcagtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggtttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgtaaaaaaaaacaaaaaaaagcttttatgatggattttgtaaatagatttgttacagggtgacctgttctctagctgtgatcttaccacttcaaatgggtgtaatttgaataaattttgtatggtaaaggatcaataaaatgattttttttaagagttc

SEQ ID NO: 128840 - DNA, 4425 bp, Homo sapiens
  Payload ID: 5200
  Gene Symbol: E2F3
  Gene Name: E2F transcription factor 3
  Uniprot ID: O00716
  ENST ID: ENST00000535432
  CDS Start-End: 137-1141
accgccaccctccctctcctctccccacccccccaccggcgcccgccctcgccctgcgccgccggtctgttcggccctccgggccccctctccagccggccccccacctccccccggagccaggctggtttcggaaatgcccttacagcagcaggcaaagcgaaggctggagctaggagaaagcggtcatcagtacctctcagatggtttaaaaacccccaagggcaaaggaagagctgcactacgaagtccagatagtccaaaaaaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatccacctcattaagaagaagtctaaaaacaacgtccaatggatgggctgcagtctgtctgaggatgggggcatgctggcccagtgtcaaggcctgtcaaaagaagtgaccgagctcagtcaggaagagaagaaattagatgaactgatccaaagctgcaccctggacctcaaactgttaaccgaggattcagagaatcaaaggttagcttatgttacatatcaagatattcgaaaaattagtggccttaaagaccaaactgttatagttgtgaaagcccctccagaaacaagacttgaagtgcctgactcaatagagagcctacaaatacatttggcaagtacccaagggcccattgaggtttacttatgtccagaagagactgaaacacacagtccaatgaaaacaaacaaccaagaccacaatgggaatatccctaaacccgcttccaaagacttggcttcaaccaactcaggacatagcgattgctcagtttctatgggaaacctttctcctctggcctccccagccaacctcttacagcagactgaggaccaaattccttccaacctagaaggaccgtttgtgaacttactgcctcccctgctgcaagaggactatctcctgagcctcggggaggaggaaggcatcagcgatctcttcgatgcttacgatttggaaaagctcccactggtggaagacttcatgtgtagttgattatgcttcgtgtgaactctccttaaaaaccgatatttttttatcatggaaccagaacatctgtcatgcagtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggtttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgtaaaaaaaaacaaaaaaaagcttttatgatggattttgtaaatagatttgttacagggtgacctgttctctagctgtgatcttaccacttcaaatgggtgtaatttgaataaattttgtatggtaaaggatcaataaaatgattttttttaagagtt

SEQ ID NO: 128841 - DNA, 4094 bp, Homo sapiens
  Payload ID: 5200
  Gene Symbol: E2F3
  Gene Name: E2F transcription factor 3
  ENST ID: ENST00000613242
  CDS Start-End: 424-810
gccatttttcagctgccggccgcagcacccgggctgccgccgccgcctcgcaatccgttgcatcggccgcccccgacgcctccatccccgcttggggcccgatatccgtgcggccgggaccctcctctctccagagccccgattatttttggcccccggggcctgtgcggtgcggaaaaataaaaagaaaagagagagagggggctcggaagcgccgggcggggaggagagaaggaggagagacttggaaactccgactgcaaataataaagaaattgaaaacaatacattaatataccataacactaaaaagagcaggagcgagagatgagaaagggaatccagcccgctctggagcagtacctggtgaccgccgggggtggggagggggcggctgtcgtcgccgccgccgctgcagcctccatggacaaaagggcactgctagccagccccggcttcgccgccccgccggcaaagcgaaggctggagctaggagaaagcggtcatcagtacctctcagatggtttaaaaacccccaagggcaaaggaagagctgcactacgaagtccagatagtccaaaaaaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatcagcgatctcttcgatgcttacgatttggaaaagctcccactggtggaagacttcatgtgtagttgattatgcttcgtgtgaactctccttaaaaaccgatatttttttatcatggaaccagaacatctgtcatgcagtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggtttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgtaaaaaaaaacaaaaaaaagcttttatgatggattttgtaaatagatttgttacagggtgacctgttctctagctgtgatcttaccacttcaaatgggtgtaatttgaataaattttgtatggtaaaggatcaataaaatgattttttttaagagtt

SEQ ID NO: 128842 - DNA, 2096 bp, Homo sapiens
  Payload ID: 5201
  Gene Symbol: E2F4
  Gene Name: E2F transcription factor 4, p107/p130-binding
  Uniprot ID: Q16254
  ENST ID: ENST00000379378
  CDS Start-End: 60-1301
aagtggcggcggcgccggcctggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggtatcgggctaatcgagaaaaagtccaagaacagcatccagtggaagggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgtttggcctacgtcactcatgaggacatctgcagatgctttgctggagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtgttttggaactccccaaagagctgtcagaaatctttgatcccacacgagagtgcatgagctcggagctgctggaggagttgatgtcctcagaagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggcta

SEQ ID NO: 128843 - DNA, 639 bp, Homo sapiens
  Payload ID: 5201
  Gene Symbol: E2F4
  Gene Name: E2F transcription factor 4, p107/p130-binding
  ENST ID: ENST00000565849
  CDS Start-End: 39-284
ggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgtttggcctacgtcactcatgaggacatctgcagatgctttgctggagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgct

SEQ ID NO: 128844 - DNA, 849 bp, Homo sapiens
  Payload ID: 5201
  Gene Symbol: E2F4
  Gene Name: E2F transcription factor 4, p107/p130-binding
  ENST ID: ENST00000569573
  CDS Start-End: 21-386
ggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggtatcgggctaatcgagaaaaagtccaagaacagcatccagtggaagagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtggt

SEQ ID NO: 128845 - DNA, 944 bp, Homo sapiens
  Payload ID: 5201
  Gene Symbol: E2F4
  Gene Name: E2F transcription factor 4, p107/p130-binding
  ENST ID: ENST00000568839
  CDS Start-End: 22-459
gggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggtatcgggctaatcgagaaaaagtccaagaacagcatccagtggaatctgccatctgtcaccatagggcatcagccattctccttaaccctcacactttggcctacgtcactcatgaggacatctgcagatgctttgctggagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtggt

SEQ ID NO: 128846 - DNA, 446 bp, Homo sapiens
  Payload ID: 5201
  Gene Symbol: E2F4
  Gene Name: E2F transcription factor 4, p107/p130-binding
  ENST ID: ENST00000565226
  CDS Start-End: 1-433
aatggctggcccagcagctgagatcacagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtgttttggaactccccaaagagctgtcagaaatctttgatcccacacgagagtgcatgagctcggagctgctggaggagttgatgtcctcagaagggacatgccctgtgtggctgggacccagactgtctgacctgggggttgcctggggacctctcccacccgacccctacagagcttgagagccacagacgc

SEQ ID NO: 128847 - DNA, 5042 bp, Homo sapiens
  Payload ID: 5202
  Gene Symbol: E2F5
  Gene Name: E2F transcription factor 5, p130-binding
  ENST ID: ENST00000256117
  CDS Start-End: 1-748
gctgctgcaggaggccaaggacggcgttctggatctcaaagcggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacggtaagtaggttaaaattttactaactcacttatcagtaatgcttctgtggaatttataagtgaaacatgatttaaaagaaatgaacatatatttgctacctgctttactatgaagattcatgaaaattctcccttaacacttacagtaagtaataggcaaccttcagaatttatttttctttgcttgcattttgagggaaaggaatccatatggggatacttctcaccttcattgaaaataaactgttagccctttccactcctgaaggatctggtccaagaagagtaaaataacttgtctaaatcaagcaactgatctgaacacctgcctttgtaaatacccctacccaggccaatttcaagctgccaatgggaagtcactgaattagtattaatattaaccatgttgtcatctaacctgaaaaattattaaatatcagttagctacaatatgctaattactttaataatttctctccttctgtaagttcttggatcagagtcctactacctaacaaataaagtagaaacctacgaagtggtagcagttaagttagcaaatgttatagtaactagagatgtactaaacatgtatgtagaagcagagaacatcagcaaactttgtaagtccagttcattcttctgtttgcaaagtggaaaacaaaacactttcattagtgttctgttttttttttttaaggcagagtctccctctgtcatccaggctggagtgtcatccaggctggagtgcagtggcatgatagctcactgcaacctccacctcctaggttcaaatgattctcctggctcagcctcccgagtagctgggatgacaggcacctgccaccacacctggctactttttgtatttttagtagagacggggtttcaccatgttggccaggctggtctcaaactcctggcctcaggtgatccacctgcctcagcctcccaaagtgttgggattacaggcatgagccactgcacctggcctcgttagtgccttttagttatattaccttagtgataagttcaaccaataaaaaatttaatttctaggccgggcacaatggctcatgcctgtaatcccagcactttgggaggccaaggcgggcgaatcacgtcaggagatcgagaccatcctggctaacatggtgaaaccccatctctataaaaaaataaaaaaaatgagccggtcgtggtggcaggcacctgtagtcccagctactcgggaggctgaggcaggagaatggcgtgaacccgggagtcgggagcttgcagtgggccgagatcgagctactgcactccagcctggacgaaacagggagactccatcttaaaaaaaaaaaaaaaaaaagaaaaaattaacttctgtttctcaatctaatatcaatattcaatgtacaaattgttactaaatgagaatatttcaaaatacacattacacaagactttaatttggaatgatgtatttgagagtattttgttaaagatcattaaccgtatgtagaaaccatctttaacactaaatttgttttttgttcgcagtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacattcaatttattggtctttgtggagaattagatgcatcaccagtatattacaacagagccattaatcttgtagcttcatcaacattaactggtttgctttcatgacgctgctgaggaatctgaaaggagaaagtattatatttaaaaacacagacaacaatagcagacaaatgacttatataagctgttattcaatttaatttttctagtcatatctttggaagtagaacaatctgtatattctgacaatgttttagagtctgaatatgctatttatactatagagcctagtactagagagccaagtactaaaaattacactcaacttacaggctttgaaaacttgggagtttaatttattagcctcaatttgttagccataaaaaaaagcaaatgatttctgcttaccagttctttctgcagaggttcaagtgaaatgctttttgcgaaatgtgcaagttccttttgtacatttacaaaagctttatttactctgttaactttttcctcattcataatgtttatcttttaaaaagaaaaaaagcattaatctatgatctcataaccattaaagataagatatattcaaccttaacctgttaaatctaaaatctaaaaactcttaccaacaaattagggataattcactcaaaaattcttatagtcttattgggaaattacagacaaaaagttttggtttttaaaaaatgggatttatgtggctatgcctcacacttatggttcagaaggctaaaatatgtgactgtgatattgtgattcataataagatatatatatatatttggtctttgtcctcatttcctgtcatacagctttttaaatcattgtattaagagggataagagtgtcttttgaatgctaataagatggctggtagctgggagtctctagatagcttcaggaggagggctagtcagataaaaacacagggttagaggattaggactttctgctccagaggagtggggataaaggttaagcccatcactaatggccaatgatttaatgaattatgcctacataatgaagcctccggaaatctacaaaagaactgggttcaaagagcttctggatagctgaacacatgggggctcctagaaagtggcatgcccagagagagcagggaagctccatgccccttcccatgtaccttgccctctgcacctcttccatctggctacgcatctgtcccctttgtaatatcctttataataaactggtaaaagtattttcctgggttctgtgagctgctctagcaaattaatcaaacccaaggagggggtcatgggaacacttatttataactggttggtgagaagcacaggtaaaacatctgggacttgtgattgtcactggaagttggggagaggcttaggactcaactctcaacctgtggaatctgacgctatctccaggtcagcagtgtcagattttaattaaaggacacccagctgctgcctgctgaagattcatctgcagaattgttaggtgtgggggaactgccccacaaatctagtattggaagtgttgagtgaccgtatgagagtgagagtaagagaaactgagttgcttttttcctgtatccttacagtgaccaaaatctttctaggctacagtgctgtcatcccgcatctatacaagaaacctggatcaaatacttttagtcccttctaacataacaatacgtctctgaatccttcctggaccttcttgtcttaatggaagacccctgatgacagcttccctcgcagtcctcctcttgagtttaacagaggtttttgtttgaattgcagatgtcttcaaagatacaagaattactgaggagaaaaagaatgggtgctcactgacatcccatgtcttgcctctattaatacattcttacatttgagtttagagataagaactgtttcccatactatggtttttaaatgagttctatggttcagtaaaactattaaattgaagcttcacac

SEQ ID NO: 128848 - DNA, 1728 bp, Homo sapiens
  Payload ID: 5202
  Gene Symbol: E2F5
  Gene Name: E2F transcription factor 5, p130-binding
  Uniprot ID: Q15329
  ENST ID: ENST00000416274
  CDS Start-End: 35-1075
cgcgggggcccgaccaccgcggggccgggacgcgatggcggcggcagagcccgcgagctcgggccagcaggcgccggcagggcaggggcagggccagcggccgccgccgcagcctccgcaggcgcaagccccgcagccgcccccgccgccgcagctcgggggcgccgggggcggcagcagcaggcacgagaagagcctggggctgctcactaccaagttcgtgtcgctgctgcaggaggccaaggacggcgttctggatctcaaagcggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacatt

SEQ ID NO: 128849 - DNA, 1890 bp, Homo sapiens
  Payload ID: 5202
  Gene Symbol: E2F5
  Gene Name: E2F transcription factor 5, p130-binding
  Uniprot ID: Q15329
  ENST ID: ENST00000418930
  CDS Start-End: 197-1234
gcggaggcccggcgtgacaagcggcccagactcccgtgggcgccgcacacctgttgtttgcagcagccagcgacccgcactaccgctctcggcgggcggggaagcggccgcagcggagccgacccggcaggtggccgcgggcggggccggcgagcgaaagtgcgcgggggcccgaccaccgcggggccgggacgcgatggcggcggcagagcccgcgagctcgggccagcaggcgccggcagggcaggggcagggccagcggccgccgccgcagcctccgcaggcgcaagccccgcagccgcccccgccgccgcagctcgggggcgccgggggcggcagcagcaggcacgagaagagcctggggctgctcactaccaagttcgtgtcgctgctgcaggaggccaaggacggcgttctggatctcaaagcggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacattcaa

SEQ ID NO: 128850 - DNA, 1551 bp, Homo sapiens
  Payload ID: 5202
  Gene Symbol: E2F5
  Gene Name: E2F transcription factor 5, p130-binding
  ENST ID: ENST00000521429
  CDS Start-End: 402-923
aagcaagcctcttataggcagcataagttgagtgtttttaaaaatccatttaactactttgcctttttattggagaacttaatccacttacgttcagggttatcattcataggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtaagtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttt

SEQ ID NO: 128851 - DNA, 1094 bp, Homo sapiens
  Payload ID: 5202
  Gene Symbol: E2F5
  Gene Name: E2F transcription factor 5, p130-binding
  Uniprot ID: Q15329
  ENST ID: ENST00000517476
  CDS Start-End: 362-919
aagcaagcctcttataggcagcataagttgagtgtttttaaaaatccatttaactactttgcctttttattggagaacttaatccacttacgttcagggttatcattcataggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaaggg

SEQ ID NO: 128852 - DNA, 674 bp, Homo sapiens
  Payload ID: 5202
  Gene Symbol: E2F5
  Gene Name: E2F transcription factor 5, p130-binding
  ENST ID: ENST00000518234
  CDS Start-End: 1-549
tcctatgacagtacattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgttgaccaaaatctttctaggctacagtgctgtcatcccgcatctatacaagaaacctggatcaaatacttttagtcccttctaaca

SEQ ID NO: 128853 - DNA, 604 bp, Homo sapiens
  Payload ID: 5202
  Gene Symbol: E2F5
  Gene Name: E2F transcription factor 5, p130-binding
  ENST ID: ENST00000520225
  CDS Start-End: 1-391
aaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacattcaa

SEQ ID NO: 128854 - DNA, 3317 bp, Homo sapiens
  Payload ID: 5203
  Gene Symbol: E2F6
  Gene Name: E2F transcription factor 6
  Uniprot ID: O75461
  ENST ID: ENST00000307236
  CDS Start-End: 466-1215
atgcgcagaggggggcggtgtactgcgcatgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgttgtttattcaggcaaatctggcttgctgggctaggctcagctgagggctgccttcgccatgaatccttctccatcaaaaataaggattaatttagaagataatgtacaatatgtgtccatgagaaaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtacctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaataagtgagtggagtgagtgaattgtaagatcagaataataatatttggtttgtctatcgtacaagattcctgtatcgtttgaatattgcttttaaagaaatatttgaagcgacttcaaattcagactgtgtttaaaaagatttaaaatcggaatccaaaatcaaagtattaaaaaataatgctgagtgtttaggattcacatacctctgagctctggtggcttttgccagtcctgtccctctgctgagcaccagcccttcctgcagcagtcctgccggtgtgtttctgtgcacctggggatgaagtgtgctcctcccccagcggttagcctcaatgcttttcctccctctgttttattatttgaaattagccaaagaaaagctgcagggggcactgctgatcatcactggactggtgggtcgtactgtttgacagaatagggaatacaggaggaggagcaagcctagggtaaaacttaggtttgggacatgcttgatgaaagcaagagttgagcaggttgttgtgtgtatgtaggtcaggtgctcagcggaaaagtctgagctgtgtagtacgtcaggcagatgtcagtttagatgcgatagtttaagccacaagagtaggagaggtcatctaaagagtacagcaggcctaagggcatctatatttaaggagaaatacagaagaagtctcctgagaaggaataatggggcgggtggggagggagaaggcagtgtcccaaaaaccaacaaaggttttaccaaaggtaataccatcatttctgagcagcagttccttaacttgtgaatgtggcaaatgttctcctttacaaattgttctgaaggtaaaatgagatcatgtaaacgaaaatcctttgtaaattacagatgtgtgttataaatgaagtatctctcgagtcactcca

SEQ ID NO: 128855 - DNA, 3218 bp, Homo sapiens
  Payload ID: 5203
  Gene Symbol: E2F6
  Gene Name: E2F transcription factor 6
  Uniprot ID: O75461
  ENST ID: ENST00000381525
  CDS Start-End: 271-1116
atgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgccatcaaaaataaggattaatttagaagataatgtacaatatgtgtccatgagaaaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtacctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaataagtgagtggagtgagtgaattgtaagatcagaataataatatttggtttgtctatcgtacaagattcctgtatcgtttgaatattgcttttaaagaaatatttgaagcgacttcaaattcagactgtgtttaaaaagatttaaaatcggaatccaaaatcaaagtattaaaaaataatgctgagtgtttaggattcacatacctctgagctctggtggcttttgccagtcctgtccctctgctgagcaccagcccttcctgcagcagtcctgccggtgtgtttctgtgcacctggggatgaagtgtgctcctcccccagcggttagcctcaatgcttttcctccctctgttttattatttgaaattagccaaagaaaagctgcagggggcactgctgatcatcactggactggtgggtcgtactgtttgacagaatagggaatacaggaggaggagcaagcctagggtaaaacttaggtttgggacatgcttgatgaaagcaagagttgagcaggttgttgtgtgtatgtaggtcaggtgctcagcggaaaagtctgagctgtgtagtacgtcaggcagatgtcagtttagatgcgatagtttaagccacaagagtaggagaggtcatctaaagagtacagcaggcctaagggcatctatatttaaggagaaatacagaagaagtctcctgagaaggaataatggggcgggtggggagggagaaggcagtgtcccaaaaaccaacaaaggttttaccaaaggtaataccatcatttctgagcagcagttccttaacttgtgaatgtggcaaatgttctcctttacaaattgttctgaaggtaaaatgagatcatgtaaacgaaaatcctttgtaaattacagatgtgtgttataaatgaagtatctctcgagtcactcca

SEQ ID NO: 128856 - DNA, 907 bp, Homo sapiens
  Payload ID: 5203
  Gene Symbol: E2F6
  Gene Name: E2F transcription factor 6
  ENST ID: ENST00000421117
  CDS Start-End: 293-409
agaggggggcggtgtactgcgcatgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcaca

SEQ ID NO: 128857 - DNA, 2227 bp, Homo sapiens
  Payload ID: 5203
  Gene Symbol: E2F6
  Gene Name: E2F transcription factor 6
  ENST ID: ENST00000455198
  CDS Start-End: 1-153
atgagtcagcagcggccggcgaggaagttacccagtctcctcctggacccgacggaggagacggttcgccgtcggtgccgagaccccatcaacgtggagggcctgctgttgtttattcaggcaaatctggcttgctgggctaggctcagctgagggctgccttcgccatgaatccttctccatcaaaaataaggattaatttagaagataatgtacaatatgtgtccatgagaatgtaggaatgggctccagagagaagacatttatattatgaaatatgtacctttgttcctgaagtaaccgccagtggtctttaaactaaatgtgacattgtggaggttctgagtaaggacatttctgactgaagaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtacctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaac

SEQ ID NO: 128858 - DNA, 1253 bp, Homo sapiens
  Payload ID: 5203
  Gene Symbol: E2F6
  Gene Name: E2F transcription factor 6
  ENST ID: ENST00000437573
  CDS Start-End: 275-442
gcgcatgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgccatcaaaaataaggattaatttagaagataatgtacaatatgtgtccatgagaatgtaggaatgggctccagagagaagacatttatattatgaaatatgtacctttgttcctgaagtaaccgccagtggtctttaaactaaatgtgacattgtggaggttctgagtaaggacatttctgactgaagaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactga

SEQ ID NO: 128859 - DNA, 3139 bp, Homo sapiens
  Payload ID: 5203
  Gene Symbol: E2F6
  Gene Name: E2F transcription factor 6
  ENST ID: ENST00000428221
  CDS Start-End: 268-459
cgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgccatcaaaaataaggattaatttagaagataatgtacaatatgtgtccatgagaaatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtacctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaataagtgagtggagtgagtgaattgtaagatcagaataataatatttggtttgtctatcgtacaagattcctgtatcgtttgaatattgcttttaaagaaatatttgaagcgacttcaaattcagactgtgtttaaaaagatttaaaatcggaatccaaaatcaaagtattaaaaaataatgctgagtgtttaggattcacatacctctgagctctggtggcttttgccagtcctgtccctctgctgagcaccagcccttcctgcagcagtcctgccggtgtgtttctgtgcacctggggatgaagtgtgctcctcccccagcggttagcctcaatgcttttcctccctctgttttattatttgaaattagccaaagaaaagctgcagggggcactgctgatcatcactggactggtgggtcgtactgtttgacagaatagggaatacaggaggaggagcaagcctagggtaaaacttaggtttgggacatgcttgatgaaagcaagagttgagcaggttgttgtgtgtatgtaggtcaggtgctcagcggaaaagtctgagctgtgtagtacgtcaggcagatgtcagtttagatgcgatagtttaagccacaagagtaggagaggtcatctaaagagtacagcaggcctaagggcatctatatttaaggagaaatacagaagaagtctcctgagaaggaataatggggcgggtggggagggagaaggcagtgtcccaaaaaccaacaaaggttttaccaaaggtaataccatcatttctgagcagcagttccttaacttgtgaatgtggcaaatgttctcctttacaaattgttctgaaggtaaaatgagatcatgtaaacgaaaatcctttgtaaattacagatgtgtgttataaatgaagtatctctcgagtcactcca

SEQ ID NO: 128860 - DNA, 3296 bp, Homo sapiens
  Payload ID: 5203
  Gene Symbol: E2F6
  Gene Name: E2F transcription factor 6
  ENST ID: ENST00000444832
  CDS Start-End: 278-430
actgcgcatgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgttgtttattcaggcaaatctggcttgctgggctaggctcagctgagggctgccttcgccatgaatccttctccatcaaaaataaggattaatttagaagataatgtacaatatgtgtccatgagaaaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtacctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaataagtgagtggagtgagtgaattgtaagatcagaataataatatttggtttgtctatcgtacaagattcctgtatcgtttgaatattgcttttaaagaaatatttgaagcgacttcaaattcagactgtgtttaaaaagatttaaaatcggaatccaaaatcaaagtattaaaaaataatgctgagtgtttaggattcacatacctctgagctctggtggcttttgccagtcctgtccctctgctgagcaccagcccttcctgcagcagtcctgccggtgtgtttctgtgcacctggggatgaagtgtgctcctcccccagcggttagcctcaatgcttttcctccctctgttttattatttgaaattagccaaagaaaagctgcagggggcactgctgatcatcactggactggtgggtcgtactgtttgacagaatagggaatacaggaggaggagcaagcctagggtaaaacttaggtttgggacatgcttgatgaaagcaagagttgagcaggttgttgtgtgtatgtaggtcaggtgctcagcggaaaagtctgagctgtgtagtacgtcaggcagatgtcagtttagatgcgatagtttaagccacaagagtaggagaggtcatctaaagagtacagcaggcctaagggcatctatatttaaggagaaatacagaagaagtctcctgagaaggaataatggggcgggtggggagggagaaggcagtgtcccaaaaaccaacaaaggttttaccaaaggtaataccatcatttctgagcagcagttccttaacttgtgaatgtggcaaatgttctcctttacaaattgttctgaaggtaaaatgagatcatgtaaacgaaaatcctttgtaaattacagatgtgtgttataaatgaagtatctctcgagtcactcca

SEQ ID NO: 128861 - DNA, 3191 bp, Homo sapiens
  Payload ID: 5203
  Gene Symbol: E2F6
  Gene Name: E2F transcription factor 6
  Uniprot ID: O75461
  ENST ID: ENST00000546212
  CDS Start-End: 469-1089
atgcgcagaggggggcggtgtactgcgcatgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtacctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaataagtgagtggagtgagtgaattgtaagatcagaataataatatttggtttgtctatcgtacaagattcctgtatcgtttgaatattgcttttaaagaaatatttgaagcgacttcaaattcagactgtgtttaaaaagatttaaaatcggaatccaaaatcaaagtattaaaaaataatgctgagtgtttaggattcacatacctctgagctctggtggcttttgccagtcctgtccctctgctgagcaccagcccttcctgcagcagtcctgccggtgtgtttctgtgcacctggggatgaagtgtgctcctcccccagcggttagcctcaatgcttttcctccctctgttttattatttgaaattagccaaagaaaagctgcagggggcactgctgatcatcactggactggtgggtcgtactgtttgacagaatagggaatacaggaggaggagcaagcctagggtaaaacttaggtttgggacatgcttgatgaaagcaagagttgagcaggttgttgtgtgtatgtaggtcaggtgctcagcggaaaagtctgagctgtgtagtacgtcaggcagatgtcagtttagatgcgatagtttaagccacaagagtaggagaggtcatctaaagagtacagcaggcctaagggcatctatatttaaggagaaatacagaagaagtctcctgagaaggaataatggggcgggtggggagggagaaggcagtgtcccaaaaaccaacaaaggttttaccaaaggtaataccatcatttctgagcagcagttccttaacttgtgaatgtggcaaatgttctcctttacaaattgttctgaaggtaaaatgagatcatgtaaacgaaaatcctttgtaaattacagatgtgtgttataaatgaagtatctctcgagtcactcca

SEQ ID NO: 128862 - DNA, 3450 bp, Homo sapiens
  Payload ID: 5203
  Gene Symbol: E2F6
  Gene Name: E2F transcription factor 6
  Uniprot ID: O75461
  ENST ID: ENST00000542100
  CDS Start-End: 728-1348
atgcgcagaggggggcggtgtactgcgcatgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgttgtttattcaggcaaatctggcttgctgggctaggctcagctgagggctgccttcgccatgaatccttctccatcaaaaataaggattaatttagaagataatgtacaatatgtgtccatgagaatgtaggaatgggctccagagagaagacatttatattatgaaatatgtacctttgttcctgaagtaaccgccagtggtctttaaactaaatgtgacattgtggaggttctgagtaaggacatttctgactgaagaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtacctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaataagtgagtggagtgagtgaattgtaagatcagaataataatatttggtttgtctatcgtacaagattcctgtatcgtttgaatattgcttttaaagaaatatttgaagcgacttcaaattcagactgtgtttaaaaagatttaaaatcggaatccaaaatcaaagtattaaaaaataatgctgagtgtttaggattcacatacctctgagctctggtggcttttgccagtcctgtccctctgctgagcaccagcccttcctgcagcagtcctgccggtgtgtttctgtgcacctggggatgaagtgtgctcctcccccagcggttagcctcaatgcttttcctccctctgttttattatttgaaattagccaaagaaaagctgcagggggcactgctgatcatcactggactggtgggtcgtactgtttgacagaatagggaatacaggaggaggagcaagcctagggtaaaacttaggtttgggacatgcttgatgaaagcaagagttgagcaggttgttgtgtgtatgtaggtcaggtgctcagcggaaaagtctgagctgtgtagtacgtcaggcagatgtcagtttagatgcgatagtttaagccacaagagtaggagaggtcatctaaagagtacagcaggcctaagggcatctatatttaaggagaaatacagaagaagtctcctgagaaggaataatggggcgggtggggagggagaaggcagtgtcccaaaaaccaacaaaggttttaccaaaggtaataccatcatttctgagcagcagttccttaacttgtgaatgtggcaaatgttctcctttacaaattgttctgaaggtaaaatgagatcatgtaaacgaaaatcctttgtaaattacagatgtgtgttataaatgaagtatctctcgagtcactcca

SEQ ID NO: 128863 - DNA, 5740 bp, Homo sapiens
  Payload ID: 5204
  Gene Symbol: E2F7
  Gene Name: E2F transcription factor 7
  Uniprot ID: Q96AV8
  ENST ID: ENST00000322886
  CDS Start-End: 237-2972
gttttagcggggactacgatccaggctggagttgcgctcggccggtctgagcgctggcgctgcccggacgccgcggggtccccgccagcccagggcactcggcgcggggatctgcgcgcctcgctctcccttcccgatgccgccgcccggctgctgatcgccgcaccaccttccctcatcggcttgggtccgtggaggtccctgcagaggcaggaagcctccttaggaaagcagggatggaggtaaattgtttaacactaaaagacctgatcagccccaggcagcccagactagattttgcagttgaagatggggaaaatgcacaaaaggaaaatatatttgttgatcgatcaaggatggccccgaagactccaataaaaaatgaaccaattgatttatcgaagcaaaaaaaatttactccagaaagaaatcccattactccagttaagtttgttgacagacagcaagcggaaccatggacacccacagctaacctgaagatgctcattagtgctgccagcccagatataagggaccgggagaagaaaaagggactattccgacccattgaaaacaaggacgatgcatttacagattctctacagcttgatgttgttggggacagtgctgtggacgaatttgaaaagcaaaggccaagcagaaaacagaaaagtttaggactcctgtgccagaagtttctagctcgctatccaagttatcccttgtcaactgagaaaactaccatctccctagatgaagttgctgtcagtcttggtgtggaaaggagacgcatctatgacattgtaaatgtgctggagtcgctgcatctggtcagccgggtggctaagaatcagtatggctggcatggacggcacagcctgccaaaaaccctgaggaacctccagagactaggagaggagcagaaatatgaagagcaaatggcctacctccaacagaaagagctggacctgatagattataaatttggagaacgtaaaaaagatggtgatccagattcccaggaacaacagttactggatttctctgaacccgactgtccctcttcatctgcaaacagtagaaaagacaagtctctgagaattatgagccagaagtttgtcatgctgttcctcgtctccaaaaccaagattgtcactctggatgtggctgccaaaatactgatagaagaaagccaagatgccccagaccatagtaaatttaaaacaaaggtacgacgcctctatgacatagccaatgttctgaccagcttggctctgataaagaaagtgcatgtaacagaagagcgaggtcgtaaaccagccttcaagtggatcgggcctgtggacttcagctcaagtgatgaagaactggtggatgtttctgcatctgtcttaccagaattgaaaagagaaacatatggccagattcaagtctgtgcaaaacagaagctggctcgccatggttcttttaacacagttcaggcttctgagaggatccagaggaaagtgaactcagaaccgagcagcccgtacagagaagaacaaggatcaggtggctactctttagaaattggaagcctggcagctgtctatagacagaaaatagaagacaattcacagggaaaagcctttgccagtaagagagtggtgcctccatcaagcagcttggaccctgttgctcctttccctgtcctctctgttgacccagaatattgtgttaatcctttagcccacccagtattttctgttgctcagacggacctgcaggcattctccatgcagaacggtctgaatggacaagtggatgtctcacttgcttctgcagcctctgctgtggagagcctgaagccagcactccttgctggccagcctctagtgtatgtgccctctgcctcactgttcatgctgtatggaagtctgcaggagggaccagcgtcagggtcagggtcagagagggatgacagaagctcagaagccccagccacagtagagctgtcatctgcaccctcagctcagaagcgcctctgtgaggagaggaaacctcaggaggaggatgagccagccactaaaaggcaaagtagggaatatgaagacggcccgctgtcgcttgtcatgcccaagaaaccctcagattccacagaccttgcctctcccaagactatgggtaacagggcatctatacccctcaaagacattcatgtgaatggccaactccctgctgcagaagagatttcaggaaaggcaacagcaaactctcttgtttcttctgagtggggaaatccttcaagaaatacagatgttgaaaagccttcaaaagaaaatgaaagcaccaaagagccttctttgctacaatatctttgtgtgcagtctcctgcaggattaaatggtttcaatgtacttttatctggcagtcaaaccccccctactgtgggcccgtcctcaggtcagctgccgtctttcagtgtcccttgcatggtcttaccatctccacctctgggcccttttcctgttctctattctcctgcaatgccgggcccggtttcttctactcttggtgctctcccaaacacaggacctgtgaatttcagcttgcctggccttggatcaatagcccagcttctcgtcggccccacagctgtggttaatccaaagtcgtccacactcccttctgcagaccctcagcttcagagtcagccctcactaaacctaagtccagtgatgtcaaggtcacacagtgtcgtccaacaacctgagtcccccgtttacgtgggacatccagtctcagtagtaaaattacatcagtcaccagttccagtgacccccaagagcatccaacgcacacatcgtgagacgtttttcaagacacccggcagccttggagaccctgtcctgaagagaagagaaaggaaccagtcacgaaacaccagctcggcccagaggagactagaaatccccagcggcggcgctgactaacctgccgctttgccaggtgggggtgggatcaaacgccctgagagtcccggatgtccgaggcgggatgcaaaccatcccgtcctgagcacgggtccttcctctctctttcatccacacttctgttaacttcccaccaccatcaatcatctgatttcctgaaagtaattaattgtgcatttaataccagttagagttccgactctgcatggtgtcacagtgaaagcgccgactgacttatggttttgattcaagaatcgtcttattctggaagtagatctgaataggctaccggagccttgtttttctaaaggggggcgctgtctagcacttaactagggtaagcattcttaacatgtatttccacttgccctgagtaaatctgtggtgagagaagcttcctttctgcagtttaaaaaagctactgcttccttaggcttcatcaggaagccaccttcagttgtgaatcctatggtgttatttattttgttcctgaaatgggatttagtgcaaaaagtttacaactacagtctttaacacatttttttcagggtatgacgacttgaatgtttatacttttattctataatttgccctgcacttattttacaacctagtaataatgtggataaatgtatctacatgacacatgtcaagaccaaaataactgtgaatgacacaccttgctgtaaatgaactgtgctaaccctgactgtgggcttgagaacaaagatgaactctagaactctagcagcctaactgctgcttctcaaataactgtgtgaacagtgagatattactgtttgtttctaaaaatcctactgtgcccagtttccttcactacatgccctgcattttttatttaaatatttagctgtagcgccatcagatatggatgccttctaacaattgctgtttgtaaaataaatcaggatggtagaaagtgattatatggaaaattggaacctggatgagaccttttcgttgaattctgaagagtaatgatgtgaaaattgatacagggcaagagatgattcttttgtttttcttctacttcatgtccagaagagtaagagggaaaatggacatatgtttcatatccaagggtattcaaactgtagttagttggtacctctgaaaaatgagaatggtgagcgcacgggttggttgttctagcatgaatacaattctggaaactgttatgcaatttcccttttttaacccacattactttaggggtgcattaagtcgccaaactatactagttctttgtattcctagacttgctgatatttacctctctcttgtctcttcagagtaaatggttcccttctttccttcctactttccttcattctctcttccttccctccttcctacttcttttcttccttcctcttcctctcttaaaactatcttagatgtagaatcctggtgtagggttttattttatttttattttttgacccaataaaatgttatatgaaagaatgaaaatattaatttaagagactctgggagtctgaataaagtagctttatattaactacaggataatattagccttattacccccacaagattttttaaaacttgaggtaggtagctacattaaataaatttgctacttatataaaaatttttatcaacactaaacttttaaagtttacaagttttttttttcttttttacagtcttctatagagttaggttaaaaatgtggttctaaccatcaacaattgcatggttaaatgaccctgaactaaaactgatgggttccctatcaaaacaaataaaaatatacctttttcaggtttcaatctgtgcagggtatatgcatgttaattctaccatgcttaagaacttccacaaaatatttcatggagaggtctgcatttagacggaaacagaaattgcttttcccctcactgttcctgaatgctctatacttgttttaacatttttgctatctttttttattattctgatcatgatatgaccatttaacctcagaattcataattcctgaggggtgttaagaagcagtcccattggtgaggatattatgacttggtgaccattcttaggagtagaaaaccaaggacaattgcttctgtattcagtatccacttcttaatgtggctttatatgtaaaaataataatgcagtggttgtttctgtcaggaaaataaatcttacagaacaactggtggaattgaagctgctgcgctagacttggatattttgggtagtgaagaagcaatggcaatcttgagtctattattgtataatttagtaaaagaaaaaaataatcgttggtggtcctactaagagaatgcagcttttttgagttgtcacagaggctgtgtgtgccctacactgaccagggtttgtaaaaccctttcattctggtacaagagtcgggggtataacttttatacttgaatctacctaccaagtttacatttctcaattcctttttgtaaggtgctatttctgtatttaaataactttcttttaacgtaaagctgctttctgcttatcttattgcactgctagttgtatgtaggtattaattttattgctgcttactgcttttgttttcttattatttagctctgctctttttcctaatggctatattatctatagctatttacttgtaactgtactacatgtaaactgattttttgttctgattttttttctaatatttttaggaaaatattaagctttataaaatagcaataaaaaataattcatttaagaag

SEQ ID NO: 128864 - DNA, 5297 bp, Homo sapiens
  Payload ID: 5204
  Gene Symbol: E2F7
  Gene Name: E2F transcription factor 7
  Uniprot ID: Q96AV8
  ENST ID: ENST00000416496
  CDS Start-End: 220-2406
gatccaggctggagttgcgctcggccggtctgagcgctggcgctgcccggacgccgcggggtccccgccagcccagggcactcggcgcggggatctgcgcgcctcgctctcccttcccgatgccgccgcccggctgctgatcgccgcaccaccttccctcatcggcttgggtccgtggaggtccctgcagaggcaggaagcctccttaggaaagcagggatggaggtaaattgtttaacactaaaagacctgatcagccccaggcagcccagactagattttgcagttgaagatggggaaaatgcacaaaaggaaaatatatttgttgatcgatcaaggatggccccgaagactccaataaaaaatgaaccaattgatttatcgaagcaaaaaaaatttactccagaaagaaatcccattactccagttaagtttgttgacagacagcaagcggaaccatggacacccacagctaacctgaagatgctcattagtgctgccagcccagatataagggaccgggagaagaaaaagggactattccgacccattgaaaacaaggacgatgcatttacagattctctacagcttgatgttgttggggacagtgctgtggacgaatttgaaaagcaaaggccaagcagaaaacagaaaagtttaggactcctgtgccagaagtttctagctcgctatccaagttatcccttgtcaactgagaaaactaccatctccctagatgaagttgctgtcagtcttggtgtggaaaggagacgcatctatgacattgtaaatgtgctggagtcgctgcatctggtcagccgggtggctaagaatcagtatggctggcatggacggcacagcctgccaaaaaccctgaggaacctccagagactaggagaggagcagaaatatgaagagcaaatggcctacctccaacagaaagagctggacctgatagattataaatttggagaacgtaaaaaagatggtgatccagattcccaggaacaacagttactggatttctctgaacccgactgtccctcttcatctgcaaacagtagaaaagacaagtctctgagaattatgagccagaagtttgtcatgctgttcctcgtctccaaaaccaagattgtcactctggatgtggctgccaaaatactgatagaagaaagccaagatgccccagaccatagtaaatttaaaacaaaggtacgacgcctctatgacatagccaatgttctgaccagcttggctctgataaagaaagtgcatgtaacagaagagcgaggtcgtaaaccagccttcaagtggatcgggcctgtggacttcagctcaagtgatgaagaactggtggatgtttctgcatctgtcttaccagaattgaaaagagaaacatatggccagattcaagtctgtgcaaaacagaagctggctcgccatggttcttttaacacagttcaggcttctgagaggatccagaggaaagtgaactcagaaccgagcagcccgtacagagaagaacaaggatcaggtggctactctttagaaattggaagcctggcagctgtctatagacagaaaatagaagacaattcacagggaaaagcctttgccagtaagagagtggtgcctccatcaagcagcttggaccctgttgctcctttccctgtcctctctgttgacccagaatattgtgttaatcctttagcccacccagtattttctgttgctcagacggacctgcaggcattctccatgcagaacggtctgaatggacaagtggatgtctcacttgcttctgcagcctctgctgtggagagcctgaagccagcactccttgctggccagcctctagtgtatgtgccctctgcctcactgttcatgctgtatggaagtctgcaggagggaccagcgtcagggtcagggtcagagagggatgacagaagctcagaagccccagccacagtagagctgtcatctgcaccctcagctcagaagcgcctctgtgaggagaggaaacctcaggaggaggatgagccagccactaaaaggcaaagtagggaatatgaagacggcccgctgtcgcttgtcatgcccaagaaaccctcagattccacagaccttgcctctcccaagactatgggtaacagggcatctatacccctcaaagacattcatgtgaatggccaactccctgctgcagaagagatttcaggaaaggcaacagcaaactctcttgtttcttctgagtggggaaatccttcaagaaatacagatgttgaaaagccttcaaaagaaaatgaaagcaccaaagagccttctttgctacaatatctttgtgtgcagtctcctgcagtcaccagttccagtgacccccaagagcatccaacgcacacatcgtgagacgtttttcaagacacccggcagccttggagaccctgtcctgaagagaagagaaaggaaccagtcacgaaacaccagctcggcccagaggagactagaaatccccagcggcggcgctgactaacctgccgctttgccaggtgggggtgggatcaaacgccctgagagtcccggatgtccgaggcgggatgcaaaccatcccgtcctgagcacgggtccttcctctctctttcatccacacttctgttaacttcccaccaccatcaatcatctgatttcctgaaagtaattaattgtgcatttaataccagttagagttccgactctgcatggtgtcacagtgaaagcgccgactgacttatggttttgattcaagaatcgtcttattctggaagtagatctgaataggctaccggagccttgtttttctaaaggggggcgctgtctagcacttaactagggtaagcattcttaacatgtatttccacttgccctgagtaaatctgtggtgagagaagcttcctttctgcagtttaaaaaagctactgcttccttaggcttcatcaggaagccaccttcagttgtgaatcctatggtgttatttattttgttcctgaaatgggatttagtgcaaaaagtttacaactacagtctttaacacatttttttcagggtatgacgacttgaatgtttatacttttattctataatttgccctgcacttattttacaacctagtaataatgtggataaatgtatctacatgacacatgtcaagaccaaaataactgtgaatgacacaccttgctgtaaatgaactgtgctaaccctgactgtgggcttgagaacaaagatgaactctagaactctagcagcctaactgctgcttctcaaataactgtgtgaacagtgagatattactgtttgtttctaaaaatcctactgtgcccagtttccttcactacatgccctgcattttttatttaaatatttagctgtagcgccatcagatatggatgccttctaacaattgctgtttgtaaaataaatcaggatggtagaaagtgattatatggaaaattggaacctggatgagaccttttcgttgaattctgaagagtaatgatgtgaaaattgatacagggcaagagatgattcttttgtttttcttctacttcatgtccagaagagtaagagggaaaatggacatatgtttcatatccaagggtattcaaactgtagttagttggtacctctgaaaaatgagaatggtgagcgcacgggttggttgttctagcatgaatacaattctggaaactgttatgcaatttcccttttttaacccacattactttaggggtgcattaagtcgccaaactatactagttctttgtattcctagacttgctgatatttacctctctcttgtctcttcagagtaaatggttcccttctttccttcctactttccttcattctctcttccttccctccttcctacttcttttcttccttcctcttcctctcttaaaactatcttagatgtagaatcctggtgtagggttttattttatttttattttttgacccaataaaatgttatatgaaagaatgaaaatattaatttaagagactctgggagtctgaataaagtagctttatattaactacaggataatattagccttattacccccacaagattttttaaaacttgaggtaggtagctacattaaataaatttgctacttatataaaaatttttatcaacactaaacttttaaagtttacaagttttttttttcttttttacagtcttctatagagttaggttaaaaatgtggttctaaccatcaacaattgcatggttaaatgaccctgaactaaaactgatgggttccctatcaaaacaaataaaaatatacctttttcaggtttcaatctgtgcagggtatatgcatgttaattctaccatgcttaagaacttccacaaaatatttcatggagaggtctgcatttagacggaaacagaaattgcttttcccctcactgttcctgaatgctctatacttgttttaacatttttgctatctttttttattattctgatcatgatatgaccatttaacctcagaattcataattcctgaggggtgttaagaagcagtcccattggtgaggatattatgacttggtgaccattcttaggagtagaaaaccaaggacaattgcttctgtattcagtatccacttcttaatgtggctttatatgtaaaaataataatgcagtggttgtttctgtcaggaaaataaatcttacagaacaactggtggaattgaagctgctgcgctagacttggatattttgggtagtgaagaagcaatggcaatcttgagtctattattgtataatttagtaaaagaaaaaaataatcgttggtggtcctactaagagaatgcagcttttttgagttgtcacagaggctgtgtgtgccctacactgaccagggtttgtaaaaccctttcattctggtacaagagtcgggggtataacttttatacttgaatctacctaccaagtttacatttctcaattcctttttgtaaggtgctatttctgtatttaaataactttcttttaacgtaaagctgctttctgcttatcttattgcactgctagttgtatgtaggtattaattttattgctgcttactgcttttgttttcttattatttagctctgctctttttcctaatggctatattatctatagctatttacttgtaactgtactacatgtaaactgattttttgttctgattttttttctaatatttttaggaaaatattaagctttataaaatagcaataaaaaataattcatttaagaa

SEQ ID NO: 128865 - DNA, 812 bp, Homo sapiens
  Payload ID: 5204
  Gene Symbol: E2F7
  Gene Name: E2F transcription factor 7
  ENST ID: ENST00000552907
  CDS Start-End: 1-627
gatgttgttggggacagtgctgtggacgaatttgaaaagcaaaggccaagcagaaaacagaaaagtttaggactcctgtgccagaagtttctagctcgctatccaagttatcccttgtcaactgagaaaactaccatctccctagatgaagttgctgtcagtcttggtgtggaaaggagacgcatctatgacattgtaaatgtgctggagtcgctgcatctggtcagccgggtggctaagaatcagtatggctggcatggacggcacagcctgccaaaaaccctgaggaacctccagagactaggagaggagcagaaatatgaagagcaaatggcctacctccaacagaaagagctggacctgatagattataaatttggagaacgtaaaaaagatggtgatccagattcccaggaacaacagttactggatttctctgaacccgactgtccctcttcatctgcaaacagtagaaaagacaagtctctgagaattatgagccagaagtttgtcatgctgttcctcgtctccaaaaccaagattgtcactctggatgtggctgccaaaatactgatagaagaaagccaagatgccccagaccatagtaaatttaaaaggtggagatgaaaattgtctacagcaaaggtacgacgcctctatgacatagccaatgttctgaccagcttggctctgataaagaaagtgcatgtaacagaagagcgaggtcgtaaaccagccttcaagtggatcgggcctgtggacttcagctcaagtgatgaagaactggtggatgtttctgcatctgtcttacc

SEQ ID NO: 128866 - DNA, 2302 bp, Homo sapiens
  Payload ID: 5204
  Gene Symbol: E2F7
  Gene Name: E2F transcription factor 7
  ENST ID: ENST00000550669
  CDS Start-End: 224-2302
ctacgatccaggctggagttgcgctcggccggtctgagcgctggcgctgcccggacgccgcggggtccccgccagcccagggcactcggcgcggggatctgcgcgcctcgctctcccttcccgatgccgccgcccggctgctgatcgccgcaccaccttccctcatcggcttgggtccgtggaggtccctgcagaggcaggaagcctccttaggaaagcagggatggaggtaaattgtttaacactaaaagacctgatcagccccaggcagcccagactagattttgcagttgaagatggggaaaatgcacaaaaggaaaatatatttgttgatcgatcaaggatggccccgaagactccaataaaaaatgaaccaattgatttatcgaagcaaaaaaaatttactccagaaagaaatcccattactccagttaagtttgttgacagacagcaagcggaaccatggacacccacagctaacctgaagatgctcattagtgctgccagcccagatataagggaccgggagaagaaaaagggactattccgacccattgaaaacaaggacgatgcatttacagattctctacagcttgatgttgttggggacagtgctgtggacgaatttgaaaagcaaaggccaagcagaaaacagaaaagtttaggactcctgtgccagaagtttctagctcgctatccaagttatcccttgtcaactgagaaaactaccatctccctagatgaagttgctgtcagtcttggtgtggaaaggagacgcatctatgacattgtaaatgtgctggagtcgctgcatctggtcagccgggtggctaagaatcagtatggctggcatggacggcacagcctgccaaaaaccctgaggaacctccagagactaggagaggagcagaaatatgaagagcaaatggcctacctccaacagaaagagctggacctgatagattataaatttggagaacgtaaaaaagatggtgatccagattcccaggaacaacagttactggatttctctgaacccgactgtccctcttcatctgcaaacagtagaaaagacaagtctctgagaattatgagccagaagtttgtcatgctgttcctcgtctccaaaaccaagattgtcactctggatgtggctgccaaaatactgatagaagaaagccaagatgccccagaccatagtaaatttaaaacaaaggtacgacgcctctatgacatagccaatgttctgaccagcttggctctgataaagaaagtgcatgtaacagaagagcgaggtcgtaaaccagccttcaagtggatcgggcctgtggacttcagctcaagtgatgaagaactggtggatgtttctgcatctgtcttaccagaattgaaaagagaaacatatggccagattcaagtctgtgcaaaacagaagctggctcgccatggttcttttaacacagttcaggcttctgagaggatccagaggaaagtgaactcagaaccgagcagcccgtacagagaagaacaaggatcaggtggctactctttagaaattggaagcctggcagctgtctatagacagaaaatagaagacaattcacagggaaaagcctttgccagtaagagagtggtgcctccatcaagcagcttggaccctgttgctcctttccctgtcctctctgttgacccagaatattgtgttaatcctttagcccacccagtattttctgttgctcagacggacctgcaggcattctccatgcagaacggtctgaatggacaagtggatgtctcacttgcttctgcagcctctgctgtggagagcctgaagccagcactccttgctggccagcctctagtgtatgtgccctctgcctcactgttcatgctgtatggaagtctgcaggagggaccagcgtcagggtcagggtcagagagggatgacagaagctcagaagccccagccacagtagagctgtcatctgcaccctcagctcagaagcgcctctgtgaggagaggaaacctcaggaggaggatgagccagccactaaaaggcaaagtagggaatatgaagacggcccgctgtcgcttgtcatgcccaagaaaccctcagattccacagaccttgcctctcccaagactatgggtaacagggcatctatacccctcaaagacattcatgtgaatggccaactccctgctgcagaagagatttcaggaaaggcaacagcaaactctcttgtttcttctgagtggggaaatccttcaagaaatacagatgttgaaaagccttcaaaa

SEQ ID NO: 128867 - DNA, 570 bp, Homo sapiens
  Payload ID: 5204
  Gene Symbol: E2F7
  Gene Name: E2F transcription factor 7
  ENST ID: ENST00000547316
  CDS Start-End: 225-570
gttgcgctcggccggtctgagcgctggcgctgcccggacgccgcggggtccccgccagcccagggcactcggcgcggggatctgcgcgcctcgctctcccttcccgatgccgccgcccggctgctgatcgccgcaccaccttccctcatcggcttgggtccgtggaggtccctgcagaggcaggaagcctccttaggaaagcagggtgtaattgtgcattacagatggaggtaaattgtttaacactaaaagacctgatcagccccaggcagcccagactagattttgcagttgaagatggggaaaatgcacaaaaggaaaatatatttgttgatcgatcaaggatggccccgaagactccaataaaaaatgaaccaattgatttatcgaagcaaaaaaaatttactccagaaagaaatcccattactccagttaagtttgttgacagacagcaagcggaaccatggacacccacagctaacctgaagatgctcattagtgctgccagcccagatataagggaccgggagaagaaaaagggactattccgacccattgaaaacaaggacg

SEQ ID NO: 128868 - DNA, 724 bp, Homo sapiens
  Payload ID: 5204
  Gene Symbol: E2F7
  Gene Name: E2F transcription factor 7
  ENST ID: ENST00000551058
  CDS Start-End: 1-659
agcttgatgttgttggggacagtgctgtggacgaatttgaaaagcaaaggccaagcagaaaacagaaaagtttaggactcctgtgccagaagtttctagctcgctatccaagttatcccttgtcaactgagaaaactaccatctccctagatgaagttgctgtcagtcttggtgtggaaaggagacgcatctatgacattgtaaatgtgctggagtcgctgcatctggtcagccgggtggctaagaatcagtatggctggcatggacggcacagcctgccaaaaaccctgaggaacctccagagactaggagaggagcagaaatatgaagagcaaatggcctacctccaacagaaagagctggacctgatagattataaatttggagaacgtaaaaaagatggtgatccagattcccaggaacaacagttactggatttctctgaacccgactgtccctcttcatctgcaaacagtagaaaagacaagtctctgagaattatgagccagaagtttgtcatgctgttcctcgtctccaaaaccaagattgtcactctggatgtggctgccaaaatactgatagaagaaagccaagatgccccagaccatagtaaatttaaaagtaagaatcttcacctccatcaacttactagcacataaagggtgggatttcatgtgttgatattttctgcttccaagattaaaaatatatatattgtttttga

SEQ ID NO: 128869 - DNA, 3240 bp, Homo sapiens
  Payload ID: 5205
  Gene Symbol: E2F8
  Gene Name: E2F transcription factor 8
  Uniprot ID: A0AVK6
  ENST ID: ENST00000250024
  CDS Start-End: 514-3117
aagtgcactgagcgagtggcggccgggggacagtacctgcttgccttattgggcaaatacagccttccaaggtggagtctaacgccgtggtgtgaactggccacccgaacagggagtaaatagtgctttgtatctttaaggaagcccttttttaaatttaaaaaaaaagtcttaattataagactctttaaatgcccaactgcatacttggagctttgggactgaatttggaactttcctgtcaagcgacctcccacgactttactgctgagcctgtgcacgtgtgtgtaaggggagaaatccaggcatctagatgcagacttgtacccagttacttggggtcgcgtgcgctcagctgggacctgggctcgtgcgcttagtccggagccctgatctgcgaacaggatattaaaacttttagtacaattgattggactacttgaaccatcgggatttggggaggaactccagatttttcatttttaaactctaaatgtatgaggaatttacagaatggagaacgaaaaggaaaatctcttttgtgagccacataaaaggggactaatgaaaacacctctgaaagaatccaccacagcaaatatcgtgttggcagagatccagcctgactttggccctttaaccacacctaccaagcccaaggaaggctctcagggagagccgtggacaccgacagccaacctgaaaatgctcatcagtgctgtgagccctgagatccgcaacagagatcagaaaaggggtttgtttgacaacagaagtggattacctgaggccaaagactgtatacacgaacacttatctggagatgaatttgagaaatcccaaccaagtcgaaaagagaaaagtttaggattattgtgtcataagttcttagcacgatatcctaattatcccaaccctgctgtgaataatgacatctgccttgacgaagtggcagaggaacttaatgttgaacgtcgacgcatttacgatatcgtgaacgtcctagagagtttacatatggtgagccgcctcgccaaaaacaggtacacttggcacgggcgacacaatctcaacaaaacccttggcaccttgaagagcatcggggaggagaataagtacgccgagcagattatgatgatcaaaaagaaagaatatgagcaagagtttgactttattaagagttacagtatagaggatcatatcatcaaatcaaacactggcccaaatggacacccagacatgtgttttgtggaactccctggagtggaatttcgggcagcttctgtaaacagccgcaaagacaagtctttaagggtaatgagccagaaatttgtgatgctgtttttggtgtcaacgcctcagatagtaagcctagaagttgctgccaagattttaattggggaggaccatgtggaagatttggataaaagcaagtttaaaacaaaaattaggaggttgtatgatatagctaatgttctgagtagcctggatcttatcaagaaagttcatgttacagaggaaagaggccgaaaaccagctttcaaatggaccggcccagaaatcagtccaaataccagtggctccagcccagtcattcattttactccctctgatttggaggtgagacggtcttcaaaagagaactgtgccaaaaacctcttttccacacgtgggaaaccaaactttactcgacacccatctcttatcaaattggtaaagagtatagaaagtgatcggagaaagataaattctgcgcccagtagccctatcaagaccaacaaagctgagagttctcagaattctgcacccttcccaagtaaaatggctcagctcgcagctatttgtaaaatgcagttagaagagcaatcaagtgaatccagacagaaagtgaaagtacagctggcaagatctggaccctgcaaaccagtagcccctctggaccccccagtgaatgctgagatggagctgacagcaccgtccctcatccagcccctgggaatggttcccctgatccccagccccttgtcatcagcagtgcccctgatcctacctcaggccccttcaggcccatcctatgccatctacctgcagcccactcaagcccaccaaagtgtgacgccaccccaaggcctgagcccaacggtgtgcaccacccactcttctaaagctactggctcaaaagactccacagatgccaccactgagaaggcagccaatgatacctcaaaggccagtgcctctaccaggcctggaagcttgctgccagcaccagagaggcaaggggcaaagagccgaaccagggagccagctggagaaagaggctcaaagagggcaagcatgctcgaggacagtggttccaaaaagaaatttaaagaggacctaaaaggacttgaaaatgtctccgcaaccttgttcccatcaggatacctaatccctctcacgcagtgctcatccctgggggcagagtccattttgtctggtaaagaaaactcaagtgctctttccccaaaccacaggatttacagctccccaattgcaggtgttattccagtgacatcatctgaactcactgctgttaattttccctcttttcatgtaacaccgttgaagctaatggtctcaccaacttccgtggcagccgtacctgtcgggaacagcccggctctcgcttcaagccaccctgttcccatccagaacccaagctcagccattgtaaacttcaccctgcagcacctgggactcatctcacccaatgtgcagttgtctgccagccctgggtctggaatcgttcctgtgtctccaagaatagagtctgttaatgtcgcaccagaaaatgcaggcactcagcaaggaagggccaccaactatgactcaccagtcccaggccagagccagccaaatggacaatcagttgctgtgacaggggcacaacagcctgttcctgtgacacccaaagggtcacaattagtggccgaaagtttcttccgtaccccaggtggacccaccaagccaaccagctcatcctgcatggattttgagggtgctaataaaacctccttaggaactctctttgtcccacagcgaaaactggaagtctcaacagaggatgtccattaatcaacagatgttggcttagtttaattttctaaagagttgtttaatagagaaaatgtacacagactgatttggagaacacattctctgaaaatactgtaaatacgttggggatttgttcaatgt

SEQ ID NO: 128870 - DNA, 3432 bp, Homo sapiens
  Payload ID: 5205
  Gene Symbol: E2F8
  Gene Name: E2F transcription factor 8
  Uniprot ID: A0AVK6
  ENST ID: ENST00000527884
  CDS Start-End: 234-2837
aaatcgggggcttggctgctcctggacggtcacgctccctctgcccgccagccggcccgccagtcccggtcccggcgtctctctccggcacccacctcggcgctgcggaaagactgactgccaggatattaaaacttttagtacaattgattggactacttgaaccatcgggatttggggaggaactccagatttttcatttttaaactctaaatgtatgaggaatttacagaatggagaacgaaaaggaaaatctcttttgtgagccacataaaaggggactaatgaaaacacctctgaaagaatccaccacagcaaatatcgtgttggcagagatccagcctgactttggccctttaaccacacctaccaagcccaaggaaggctctcagggagagccgtggacaccgacagccaacctgaaaatgctcatcagtgctgtgagccctgagatccgcaacagagatcagaaaaggggtttgtttgacaacagaagtggattacctgaggccaaagactgtatacacgaacacttatctggagatgaatttgagaaatcccaaccaagtcgaaaagagaaaagtttaggattattgtgtcataagttcttagcacgatatcctaattatcccaaccctgctgtgaataatgacatctgccttgacgaagtggcagaggaacttaatgttgaacgtcgacgcatttacgatatcgtgaacgtcctagagagtttacatatggtgagccgcctcgccaaaaacaggtacacttggcacgggcgacacaatctcaacaaaacccttggcaccttgaagagcatcggggaggagaataagtacgccgagcagattatgatgatcaaaaagaaagaatatgagcaagagtttgactttattaagagttacagtatagaggatcatatcatcaaatcaaacactggcccaaatggacacccagacatgtgttttgtggaactccctggagtggaatttcgggcagcttctgtaaacagccgcaaagacaagtctttaagggtaatgagccagaaatttgtgatgctgtttttggtgtcaacgcctcagatagtaagcctagaagttgctgccaagattttaattggggaggaccatgtggaagatttggataaaagcaagtttaaaacaaaaattaggaggttgtatgatatagctaatgttctgagtagcctggatcttatcaagaaagttcatgttacagaggaaagaggccgaaaaccagctttcaaatggaccggcccagaaatcagtccaaataccagtggctccagcccagtcattcattttactccctctgatttggaggtgagacggtcttcaaaagagaactgtgccaaaaacctcttttccacacgtgggaaaccaaactttactcgacacccatctcttatcaaattggtaaagagtatagaaagtgatcggagaaagataaattctgcgcccagtagccctatcaagaccaacaaagctgagagttctcagaattctgcacccttcccaagtaaaatggctcagctcgcagctatttgtaaaatgcagttagaagagcaatcaagtgaatccagacagaaagtgaaagtacagctggcaagatctggaccctgcaaaccagtagcccctctggaccccccagtgaatgctgagatggagctgacagcaccgtccctcatccagcccctgggaatggttcccctgatccccagccccttgtcatcagcagtgcccctgatcctacctcaggccccttcaggcccatcctatgccatctacctgcagcccactcaagcccaccaaagtgtgacgccaccccaaggcctgagcccaacggtgtgcaccacccactcttctaaagctactggctcaaaagactccacagatgccaccactgagaaggcagccaatgatacctcaaaggccagtgcctctaccaggcctggaagcttgctgccagcaccagagaggcaaggggcaaagagccgaaccagggagccagctggagaaagaggctcaaagagggcaagcatgctcgaggacagtggttccaaaaagaaatttaaagaggacctaaaaggacttgaaaatgtctccgcaaccttgttcccatcaggatacctaatccctctcacgcagtgctcatccctgggggcagagtccattttgtctggtaaagaaaactcaagtgctctttccccaaaccacaggatttacagctccccaattgcaggtgttattccagtgacatcatctgaactcactgctgttaattttccctcttttcatgtaacaccgttgaagctaatggtctcaccaacttccgtggcagccgtacctgtcgggaacagcccggctctcgcttcaagccaccctgttcccatccagaacccaagctcagccattgtaaacttcaccctgcagcacctgggactcatctcacccaatgtgcagttgtctgccagccctgggtctggaatcgttcctgtgtctccaagaatagagtctgttaatgtcgcaccagaaaatgcaggcactcagcaaggaagggccaccaactatgactcaccagtcccaggccagagccagccaaatggacaatcagttgctgtgacaggggcacaacagcctgttcctgtgacacccaaagggtcacaattagtggccgaaagtttcttccgtaccccaggtggacccaccaagccaaccagctcatcctgcatggattttgagggtgctaataaaacctccttaggaactctctttgtcccacagcgaaaactggaagtctcaacagaggatgtccattaatcaacagatgttggcttagtttaattttctaaagagttgtttaatagagaaaatgtacacagactgatttggagaacacattctctgaaaatactgtaaatacgttggggatttgttcaatgtgaaatcagatagttgttttcatacatatatatatatacacacacacacacacacacacacacacatatatttgtataaagctaagtttagctttcaatcctacaaaataaaagtaaaatgttgaactctaagatatattaacttctagggggaaaaatccattattttagctatgcctatactattatgcaaagtaactgtattaaagtttacttccctctaagcaaatatgcttgacatgcctaacacagcattcccttaaacattttgcacaaagaaaatgctgtgtgatgtataatgttgtatttttaaataggggtatagctatattttttgtaatttctttaatctgttgttgcagtgtatctttttgtaaagtttgcaacaatcctcaatcaagtctatggaaaaattatttataaaatgtatttttaatcataagttgttcaaattaaaacttttctaaaatata

SEQ ID NO: 128871 - DNA, 719 bp, Homo sapiens
  Payload ID: 5205
  Gene Symbol: E2F8
  Gene Name: E2F transcription factor 8
  ENST ID: ENST00000532666
  CDS Start-End: 302-719
tggacggtcacgctccctctgcccgccagccggcccgccagtcccggtcccggcgtctctctccggcacccacctcggcgctgcggaaagactgactgccaggtacgcgggctcccgggcctgagaggggcagcggtgctgacgagtcccggctcagcccccgccggctcccgccgtgaggtggactgacaggatattaaaacttttagtacaattgattggactacttgaaccatcgggatttggggaggaactccagatttttcatttttaaactctaaatgtatgaggaatttacagaatggagaacgaaaaggaaaatctcttttgtgagccacataaaaggggactaatgaaaacacctctgaaagaatccaccacagcaaatatcgtgttggcagagatccagcctgactttggccctttaaccacacctaccaagcccaaggaaggctctcagggagagccgtggacaccgacagccaacctgaaaatgctcatcagtgctgtgagccctgagatccgcaacagagatcagaaaaggggtttgtttgacaacagaagtggattacctgaggccaaagactgtatacacgaacacttatctggagatgaatttgagaaatcccaaccaagtcgaaaagagaaaagtttaggattattgtgtcataagttcttagcacgatatcctaattatcccaaccctgctgtgaataatg

SEQ ID NO: 128872 - DNA, 3519 bp, Homo sapiens
  Payload ID: 5205
  Gene Symbol: E2F8
  Gene Name: E2F transcription factor 8
  Uniprot ID: A0AVK6
  ENST ID: ENST00000620009
  CDS Start-End: 324-2927
aaatcgggggcttggctgctcctggacggtcacgctccctctgcccgccagccggcccgccagtcccggtcccggcgtctctctccggcacccacctcggcgctgcggaaagactgactgccaggtacgcgggctcccgggcctgagaggggcagcggtgctgacgagtcccggctcagcccccgccggctcccgccgtgaggtggactgacaggatattaaaacttttagtacaattgattggactacttgaaccatcgggatttggggaggaactccagatttttcatttttaaactctaaatgtatgaggaatttacagaatggagaacgaaaaggaaaatctcttttgtgagccacataaaaggggactaatgaaaacacctctgaaagaatccaccacagcaaatatcgtgttggcagagatccagcctgactttggccctttaaccacacctaccaagcccaaggaaggctctcagggagagccgtggacaccgacagccaacctgaaaatgctcatcagtgctgtgagccctgagatccgcaacagagatcagaaaaggggtttgtttgacaacagaagtggattacctgaggccaaagactgtatacacgaacacttatctggagatgaatttgagaaatcccaaccaagtcgaaaagagaaaagtttaggattattgtgtcataagttcttagcacgatatcctaattatcccaaccctgctgtgaataatgacatctgccttgacgaagtggcagaggaacttaatgttgaacgtcgacgcatttacgatatcgtgaacgtcctagagagtttacatatggtgagccgcctcgccaaaaacaggtacacttggcacgggcgacacaatctcaacaaaacccttggcaccttgaagagcatcggggaggagaataagtacgccgagcagattatgatgatcaaaaagaaagaatatgagcaagagtttgactttattaagagttacagtatagaggatcatatcatcaaatcaaacactggcccaaatggacacccagacatgtgttttgtggaactccctggagtggaatttcgggcagcttctgtaaacagccgcaaagacaagtctttaagggtaatgagccagaaatttgtgatgctgtttttggtgtcaacgcctcagatagtaagcctagaagttgctgccaagattttaattggggaggaccatgtggaagatttggataaaagcaagtttaaaacaaaaattaggaggttgtatgatatagctaatgttctgagtagcctggatcttatcaagaaagttcatgttacagaggaaagaggccgaaaaccagctttcaaatggaccggcccagaaatcagtccaaataccagtggctccagcccagtcattcattttactccctctgatttggaggtgagacggtcttcaaaagagaactgtgccaaaaacctcttttccacacgtgggaaaccaaactttactcgacacccatctcttatcaaattggtaaagagtatagaaagtgatcggagaaagataaattctgcgcccagtagccctatcaagaccaacaaagctgagagttctcagaattctgcacccttcccaagtaaaatggctcagctcgcagctatttgtaaaatgcagttagaagagcaatcaagtgaatccagacagaaagtgaaagtacagctggcaagatctggaccctgcaaaccagtagcccctctggaccccccagtgaatgctgagatggagctgacagcaccgtccctcatccagcccctgggaatggttcccctgatccccagccccttgtcatcagcagtgcccctgatcctacctcaggccccttcaggcccatcctatgccatctacctgcagcccactcaagcccaccaaagtgtgacgccaccccaaggcctgagcccaacggtgtgcaccacccactcttctaaagctactggctcaaaagactccacagatgccaccactgagaaggcagccaatgatacctcaaaggccagtgcctctaccaggcctggaagcttgctgccagcaccagagaggcaaggggcaaagagccgaaccagggagccagctggagaaagaggctcaaagagggcaagcatgctcgaggacagtggttccaaaaagaaatttaaagaggacctaaaaggacttgaaaatgtctccgcaaccttgttcccatcaggatacctaatccctctcacgcagtgctcatccctgggggcagagtccattttgtctggtaaagaaaactcaagtgctctttccccaaaccacaggatttacagctccccaattgcaggtgttattccagtgacatcatctgaactcactgctgttaattttccctcttttcatgtaacaccgttgaagctaatggtctcaccaacttccgtggcagccgtacctgtcgggaacagcccggctctcgcttcaagccaccctgttcccatccagaacccaagctcagccattgtaaacttcaccctgcagcacctgggactcatctcacccaatgtgcagttgtctgccagccctgggtctggaatcgttcctgtgtctccaagaatagagtctgttaatgtcgcaccagaaaatgcaggcactcagcaaggaagggccaccaactatgactcaccagtcccaggccagagccagccaaatggacaatcagttgctgtgacaggggcacaacagcctgttcctgtgacacccaaagggtcacaattagtggccgaaagtttcttccgtaccccaggtggacccaccaagccaaccagctcatcctgcatggattttgagggtgctaataaaacctccttaggaactctctttgtcccacagcgaaaactggaagtctcaacagaggatgtccattaatcaacagatgttggcttagtttaattttctaaagagttgtttaatagagaaaatgtacacagactgatttggagaacacattctctgaaaatactgtaaatacgttggggatttgttcaatgtgaaatcagatagttgttttcatacatatatatatatacacacacacacacacacacacacacacatatatttgtataaagctaagtttagctttcaatcctacaaaataaaagtaaaatgttgaactctaagatatattaacttctagggggaaaaatccattattttagctatgcctatactattatgcaaagtaactgtattaaagtttacttccctctaagcaaatatgcttgacatgcctaacacagcattcccttaaacattttgcacaaagaaaatgctgtgtgatgtataatgttgtatttttaaataggggtatagctatattttttgtaatttctttaatctgttgttgcagtgtatctttttgtaaagtttgcaacaatcctcaatcaagtctatggaaaaattatttataaaatgtatttttaatcataagttgttcaaattaaaacttttctaaaat

SEQ ID NO: 128873 - DNA, 1321 bp, Homo sapiens
  Payload ID: 5206
  Gene Symbol: EAPP
  Gene Name: E2F-associated phosphoprotein
  Uniprot ID: Q56P03
  ENST ID: ENST00000250454
  CDS Start-End: 83-940
gggcgctttagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaagaaaaaaaagaagaaacaacacaagattccaacaaatgacgaattactgtatgatcctgaaaaagataacagagatcaggcctgggttgatgcacagagaaggggttaccatggtttgggaccacagagatcacgtcaacaacagcctgttccaaatagtgatgctgtcttgaattgtcctgcctgcatgaccacactttgccttgattgccaaaggcatgaatcatacaaaactcaatatagagcaatgtttgtaatgaattgttctattaacaaagaggaggttctaagatataaagcctcagagaacaggaagaaaaggcgggtccataagaagatgaggtctaaccgggaagatgctgccgagaaggcagagacagatgtggaagaaatctatcacccagtcatgtgcactgaatgttccactgaagtggcagtctacgacaaggatgaagtctttcattttttcaatgttttagcaagccattcctaaacagcccaactggcatttaattacccaatactgtatataaggcaaatatggacagttactttcctcttgcctgttcatatccttcagtgacattgaggaagcagtgtttctctttttaaaggagaatagttgtcaaccttcattcatctcttacatctctcaccctctccttttttttttctttgattttcccccttattgatgggactgatattcattctgtttttgatgaacatttggaaactgtcgggctttttattaaagctctgtagaattaaaatgttctggaattataagcaatctttgtttctgagtgttatttttattttggatatagctttgatgtaattaaactggaaactctttcctgaattgtctgta

SEQ ID NO: 128874 - DNA, 774 bp, Homo sapiens
  Payload ID: 5206
  Gene Symbol: EAPP
  Gene Name: E2F-associated phosphoprotein
  ENST ID: ENST00000554792
  CDS Start-End: 160-774
gaaatatgcagaactggcttattaagtgagaatagctatatgtaatgtataagtacatcaaatgtaaccatgtaatacttaaaattgttgttggacagtgagatgctgggagtttaaaattattttaatttttaaatattcatattctttttgatttaaatgtatgctagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaagaaaaaaaagaagaaacaacacaagattccaacaaatgacgaattactgtatgatcctgaaaaagataacagagatcaggcctgggttgatgcacagagaaggggttaccatggtttgggaccacagagatcacgtcaacaacagcctgttccaaatagtgatgctgtcttgaattgtcctgcctgcatgaccacactttgccttgattgccaaaggcatgaatcatacaaaactcaatatagagcaatgtttgtaatgaattgttctattaacaaagaggaggttctaagatataaagcctcagagaacagg

SEQ ID NO: 128875 - DNA, 841 bp, Homo sapiens
  Payload ID: 5206
  Gene Symbol: EAPP
  Gene Name: E2F-associated phosphoprotein
  ENST ID: ENST00000555705
  CDS Start-End: 71-400
gactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcaggtgggctcccgccccaccctggcccccgaggatttgggtcgaggcctggctttggtcgcctccattcgttgcgcctgccgagcctacgcagaccctagcggctcgggagcctgtcgtgcctgttacttgtgcgaagccaaagggctttcctgatggggtcgcgcagtcccggggggaggcggtgccgatgtcgcctgtaggaagagggatattccggaatcacgggggaccgcgtgtaaatcttcaaaagcaatgagatcgaaacctgtctctacaccttagtagcagagtgacggaagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaagaaaaaaaagaagaaacaacacaagattccaacaaatgacgaattactgtatgatcctgaaaaagataacagagatcaggcctgggttgatgcacagagaagggggt

SEQ ID NO: 128876 - DNA, 1237 bp, Homo sapiens
  Payload ID: 5206
  Gene Symbol: EAPP
  Gene Name: E2F-associated phosphoprotein
  ENST ID: ENST00000618169
  CDS Start-End: 84-779
ggggcgctttagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaagaaaaaaaagaagaaacaacacaagattccaacaaatgacgaattactgtatgatcctgaaaaagataacagagatcaggcctgggttgatgcacagagaaggggttaccatggtttgggaccacagagatcacgtcaacaacagcctgttccaaatagtgatgctgtcttgtcctgcctgcatgaccactttgccttgattgccaaaggtatgaagcatgaatcatacaaaactcaatatagagcaatgtttgtaatgaattgttctattaacaaagaggaggttctaagatataaagcctcagagaacagggaaaaggcgggtccataagaagatgaggtctaaccgggaagatgctgccgagaaggcagagacagatgtggaagaaatctatcacccagtcatgtgcactgaatgttccactgaagtggcagtctacgacaaggatgaagtctttcattttttcaatgttttagcaagccattcctaaacagcccaactggcatttaattacccaatactgtatataaggcaaatatggacagttactttcctcttgcctgttcatatccttcagtgacattgaggaagcagtgtttctctttttaaaggagaatagttgtcaaccttcattcatctcttacatctctcaccctctccttttttttttctttgattttcccccttattgatgggactgatattcattctgtttttgatgaacatttggaaactgtcgggctttttattaaagctctgtagaattaaaatgttctggaattataagc

SEQ ID NO: 128877 - DNA, 2573 bp, Homo sapiens
  Payload ID: 5207
  Gene Symbol: E4F1
  Gene Name: E4F transcription factor 1
  Uniprot ID: Q66K89
  ENST ID: ENST00000301727
  CDS Start-End: 49-2403
atgacgacatggtcgtaaatccgccatcttcctgcggcgcgttgcgacatggagggcgcgatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccgccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcaggttctggagctggagctgccggcttggggacagccacatcatcggtgacaggcgagcctatagagacttcacccgtgattcacctggtgacagatgccaagggcaccgtcatccacgaagtccacgtccagatgcaggagctgtccctgggcatgaaagccctggccccagagccccccgtctcccaggagctcccctgctccagcgagggcagccgtgagaacctgctgcaccaggccatgcagaactccggcatcgtccttgagcgcgctgctggggaggagggtgccctggagccagctcctgctgccgggtccagtccccagcccctggcagtggcagccccgcagctgccggtactggaagtgcagccgctggagacacaggtggccagcgaggcctcagcggtgcccaggacccacccatgtcctcagtgcagtgagaccttcccgacagcagccaccctggaggcccacaagaggggccacaccgggccgaggccgttcgcctgcgcgcagtgtggcaaggccttccccaaggcctacctgctcaagaagcaccaggaggtgcacgtgcgtgagcgccgcttccgctgtggcgactgcgggaagctctacaagaccattgcccatgtgcgtggccaccggcgcgtccactcagacgagcggccctacccttgtcccaagtgtggcaagcgctacaagactaagaacgcacagcaggtgcacttcaggacacacctggaggagaagccgcacgtgtgccagttctgcagccgtggcttccgagagaagggctcactggtgcggcacgtgcgacaccacacaggcgagaagccgttcaagtgctacaagtgcggccgtggcttcgccgagcacggcacgctgaaccggcacctgcgcaccaaagggggctgcctgctggaggtggaggagttgctggtgtctgaggacagccccgcggcagccaccaccgtcctcacggaagacccgcacacagtgttggtggagttctcgtccgtggtagctgacacccaggagtatatcatcgaggccactgcggacgatgcggagaccagtgaggccacggagatcatcgagggcacccagacagaggtggacagccacatcatgaaggtggtgcagcagatcgtgcaccaggctagcgccggccaccagatcatcgtgcagaacgtcaccatggacgaggagacggcgctgggcccagaggcggctgccgccgacaccatcaccatcgccacccccgagagcctgacagagcaggtggccatgacgctggcctcggccatcagcgagggcactgtgcttgccgcccgggcagggacaagtggcactgaacaggccactgtgaccatggtgtcatcagaggacatcgagatcctggagcatgcaggcgagctggtcatcgcctcgccggagggccagctggaggtgcagacggtcatcgtctagcatgaggtctgcggggtcctggccgggcagggacagggcagaggactctgagcgccccacccatgcctgcctggcctggtagagaagatggcacaggatggaggcgccccaagacggacagtgtacataagagtttcttgttgctttacaataaaacatgagaacctgca

SEQ ID NO: 128878 - DNA, 940 bp, Homo sapiens
  Payload ID: 5207
  Gene Symbol: E4F1
  Gene Name: E4F transcription factor 1
  ENST ID: ENST00000565413
  CDS Start-End: 124-940
gcggccttggcccccagcggcttcctcggcctcccggcgcccttcagcgaggaaggtaaccgggccgacccggagggtgcggccggggtgcgggcagttcatcccgggctggcagaggcccggatggcccgagctgcgggctcgaccgaccctcccagacccagacacctcgcggatctcgcgggaccctcacagccctccacgaaacccccagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccgccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcag

SEQ ID NO: 128879 - DNA, 817 bp, Homo sapiens
  Payload ID: 5207
  Gene Symbol: E4F1
  Gene Name: E4F transcription factor 1
  ENST ID: ENST00000562589
  CDS Start-End: 1-626
tggagggcgcgatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaagggctggaggaaaagccagacggagccctggctgcccagcctccgccttcccaggccctgctgacagcaggctcgttgcagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccgccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgc

SEQ ID NO: 128880 - DNA, 2028 bp, Homo sapiens
  Payload ID: 5207
  Gene Symbol: E4F1
  Gene Name: E4F transcription factor 1
  ENST ID: ENST00000565090
  CDS Start-End: 35-1858
gtaaatccgccatcttcctgcggcgcgttgcgacatggagggcgcgatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccgccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcaggttctggagctggagctgccggcttggggacagccacatcatcggtgacaggcgagcctatagagacttcacccgtgattcacctggtgacagatgccaagggcaccgtcatccacgaagtccacgtccagatgcaggagctgtccctgggcatgaaagccctggccccagagccccccgtctcccaggagctcccctgctccagcgagggcagccgtgagaacctgctgcaccagttctgcagccgtggcttccgagagaagggctcactggtgcggcacgtgcgacaccacacaggcgagaagccgttcaagtgctacaagtgcggccgtggcttcgccgagcacggcacgctgaaccggcacctgcgcaccaaagggggctgcctgctggaggtggaggagttgctggtgtctgaggacagccccgcggcagccaccaccgtcctcacggaagacccgcacacagtgttggtggagttctcgtccgtggtagctgacacccaggagtatatcatcgaggccactgcggacgatgcggagaccagtgaggccacggagatcatcgagggcacccagacagaggtggacagccacatcatgaaggtggtgcagcagatcgtgcaccaggctagcgccggccaccagatcatcgtgcagaacgtcaccatggacgaggagacggcgctgggcccagaggcggctgccgccgacaccatcaccatcgccacccccgagagcctgacagagcaggtggccatgacgctggcctcggccatcagcgagggcactgtgcttgccgcccgggcagggacaagtggcactgaacaggccactgtgaccatggtgtcatcagaggacatcgagatcctggagcatgcaggcgagctggtcatcgcctcgccggagggccagctggaggtgcagacggtcatcgtctagcatgaggtctgcggggtcctggccgggcagggacagggcagaggactctgagcgccccacccatgcctgcctggcctggtagagaagatggcacaggatggaggcgccccaagacggacagtgtacataagagtttcttgttgctttacaataaaacatgagaacctgca

SEQ ID NO: 128881 - DNA, 2493 bp, Homo sapiens
  Payload ID: 5207
  Gene Symbol: E4F1
  Gene Name: E4F transcription factor 1
  ENST ID: ENST00000564139
  CDS Start-End: 21-1985
ttcctgcggcgcgttgcgacatggagggcgcgatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccgccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcaggttctggagctggagctgccggcttggggacagccacatcatcggtgacaggcgagcctatagagacttcacccgtgattcacctggtgacagatgccaagggcaccgtcatccacgaagtccacgtccagatgcaggagctgtccctgggcatgaaagccctggccccagagccccccgtctcccaggagctcccctgctccagcgagggcagccgtgagaacctgctgcaccaggccatgcagaactccggcatcgtccttgagcgcgctgctggggaggagggtgccctggagccagctcctgctgccgggtccagtccccagcccctggcagtggcagccccgcagctgccggtactggaagtgcagccgctggagacacaggtggccagcgaggcctcagcggtgcccaggacccacccatgtcctcagtgcagtgagaccttcccgacagcagccaccctggaggcccacaagaggggccacaccgggccgaggccgttcgcctgcgcgcagtgtggcaaggccttccccaaggcctacctgctcaagaagcaccaggaggtgcacgtgcgtgagcgccgcttccgctgtggcgactgcgggaagctctacaagaccattgcccatgtgcgtggccaccggcgcgtccactcagacgagcggccctacccttgtcccaagtgtggcaagcgctacaagactaagaacgcacagcaggtgcacttcaggacacacctggaggagaagccgcacgtgtgccagttctgcagccgtggcttccgagagaagggctcactggtgcggcacgtgcgacaccacacaggcgagaagccgttcaagtgctacaagtgcggccgtggcttcgccgagcacggcacgctgaaccggcacctgcgcaccaaagggggctgcctgctggaggtggaggagttgctggtgtctgaggacagccccgcggcagccaccaccgtcctcacggaagacccgcacacagtgccactgcggacgatgcggagaccagtgaggccacggagatcatcgagggcacccagacagaggtggacagccacatcatgaaggtggtgcagcagatcgtgcaccaggctagcgccggccaccagatcatcgtgcagaacgtcaccatggacgaggagacggcgctgggcccagaggcggctgccgccgacaccatcaccatcgccacccccgagagcctgacagagcaggtggccatgacgctggcctcggccatcagcgagggcactgtgcttgccgcccgggcagggacaagtggcactgaacaggccactgtgaccatggtgtcatcagaggacatcgagatcctggagcatgcaggcgagctggtcatcgcctcgccggagggccagctggaggtgcagacggtcatcgtctagcatgaggtctgcggggtcctggccgggcagggacagggcagaggactctgagcgccccacccatgcctgcctggcctggtagagaagatggcacaggatggaggcgccccaagacggacagtgtacataagagtttcttgttgctttacaataaaacatgagaacctgca

SEQ ID NO: 128882 - DNA, 3566 bp, Homo sapiens
  Payload ID: 5208
  Gene Symbol: ELF1
  Gene Name: E74-like factor 1 (ets domain transcription factor)
  Uniprot ID: P32519
  ENST ID: ENST00000239882
  CDS Start-End: 316-2175
tctacaggagccattttaacagctaaaacttgtcggattgctttttattttcaagctcaaaagacgatagagaaagaatacttgaaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccaatgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctatgctggatgaaaaacgaataaataataatatatttagttcacctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggattagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctgttatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaa

SEQ ID NO: 128883 - DNA, 903 bp, Homo sapiens
  Payload ID: 5208
  Gene Symbol: ELF1
  Gene Name: E74-like factor 1 (ets domain transcription factor)
  ENST ID: ENST00000405737
  CDS Start-End: 832-903
cccggctccaaagaggtggggtcggtataaaggggttgaggtcaccgggaaggggtaaaagcgcgacgggacctgagctgaaggacgggatctcaagcctcaagtccctgcgccatcccgccgtctctgtgtcctcccctggggcccaaaacctccatcctccttctaggctcgctggctcaaggccaaggagctcagcgcgccgcctccgcccggaacgcaaacagctgttcccagagacgtctccgctctcaactttgccaactactccgcacgcactttgaccagcggagcaaccgggacctgtgggtcggggtcctctggcggagttaaaaaaaaaagaggtgaaactgcgggaccggcgctgcgagtcgctaggcttcgcctcaaactttgctgttgcagcggagcggccccgcccctcctctcccctacgacgcccacgcgctcggatggggcttgttccctagctcgggagcgtgtgggcagcagcagcggcggcggcggcggcggcggcggcggcggcagcagcagcttcagtagcgcagaggcggcggtggcgagaggtgcggcgaaggaggcagaggcacttatgcttgtcaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacag

SEQ ID NO: 128884 - DNA, 3017 bp, Homo sapiens
  Payload ID: 5208
  Gene Symbol: ELF1
  Gene Name: E74-like factor 1 (ets domain transcription factor)
  ENST ID: ENST00000442101
  CDS Start-End: 427-1512
gcggcggcggcggcggcggcggcggcagcagcagcttcagtagcgcagaggcggcggtggcgagaggtgcggcgaaggaggcagaggcacttatgcttgtcaggccaagaagcttgagagaagaaaaatttcagaaaaattgtctcaatttgactagaatatcaatgaaccaggaaaactggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggattagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctgttatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaattctcagtgtctgttttcaggcaaaagtttcttaaagaataagtgtgcagagaatattactagaacatcagcattacttaatgtttataaataaatttcattagtcagaattgc

SEQ ID NO: 128885 - DNA, 2032 bp, Homo sapiens
  Payload ID: 5208
  Gene Symbol: ELF1
  Gene Name: E74-like factor 1 (ets domain transcription factor)
  Uniprot ID: P32519
  ENST ID: ENST00000625359
  CDS Start-End: 172-1959
atcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccaatgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctatgctggatgaaaaacgaataaatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattct

SEQ ID NO: 128886 - DNA, 3563 bp, Homo sapiens
  Payload ID: 5208
  Gene Symbol: ELF1
  Gene Name: E74-like factor 1 (ets domain transcription factor)
  ENST ID: ENST00000498824
  CDS Start-End: 189-563
ctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccaatgacatgattactgagagttcactggatgttgctgaagaagaaatcatagacgatgatgatgatgacatcacccttacagtagaaacagggtttctccatgttggccagtctcagactcctgacctcaagcaatctgcttgcctcggcttcccaaagtgcgggattacaggaatgagccactgcgccagccaggtttgttgaagcttcttgtcatgacggggatgaaacaattgaaactattgaggctgctgaggcactcctcaatatggattcccctggccctatgctggatgaaaaacgaataaataataatatatttagttcacctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggattagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctgttatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaattctca

SEQ ID NO: 128887 - DNA, 2116 bp, Homo sapiens
  Payload ID: 5208
  Gene Symbol: ELF1
  Gene Name: E74-like factor 1 (ets domain transcription factor)
  ENST ID: ENST00000635415
  CDS Start-End: 271-2116
agtgcattaaaaaagaagccactgaagacaggcttaagcatggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccaatgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctatgctggatgaaaaacgaataaataataatatatttagttcacctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaac

SEQ ID NO: 128888 - DNA, 3036 bp, Homo sapiens
  Payload ID: 5209
  Gene Symbol: ELF2
  Gene Name: E74-like factor 2 (ets domain transcription factor)
  Uniprot ID: Q15723
  ENST ID: ENST00000358635
  CDS Start-End: 307-1908
cgcgttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgattttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctg

SEQ ID NO: 128889 - DNA, 3005 bp, Homo sapiens
  Payload ID: 5209
  Gene Symbol: ELF2
  Gene Name: E74-like factor 2 (ets domain transcription factor)
  Uniprot ID: Q15723
  ENST ID: ENST00000379549
  CDS Start-End: 225-1739
gccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgattttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttgg

SEQ ID NO: 128890 - DNA, 3278 bp, Homo sapiens
  Payload ID: 5209
  Gene Symbol: ELF2
  Gene Name: E74-like factor 2 (ets domain transcription factor)
  Uniprot ID: Q15723
  ENST ID: ENST00000379550
  CDS Start-End: 231-2012
gattttagctcttcccaagttgtgaaaatagtgaaggatgcttagactacttaacatacaaactgctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacagtggaagcatcagttcacagcagtaatgcacactgtacagataagacaattgaagctgctgaagccctgcttcatatggaatctcctacctgcttgagggattcaagaagtcctgtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgattttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttgg

SEQ ID NO: 128891 - DNA, 4012 bp, Homo sapiens
  Payload ID: 5209
  Gene Symbol: ELF2
  Gene Name: E74-like factor 2 (ets domain transcription factor)
  Uniprot ID: Q15723
  ENST ID: ENST00000394235
  CDS Start-End: 504-2249
attgctcccagcgccaagctctgtgtcgccgccgtcgcctaggcggttgggggtcggtggggcggcgcgggcgggggtcgctgcgcggggcggcgagcctctgttttgtctccttctctccctgtggagcggctcgggctgctggggaggccccggctccctccggacgctcggccaacggcggcggctagtccgcggccctgctgagagggaaaaggacgccgcggtcttcccaggcgtcgcggagagcagttccaaagaactactggttcagattttagctcttcccaagttgtgaaaatagtgaaggatgcttagactacttaacatacaaactgctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacagtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgattttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttggcaaatatctgcatgttgccagtttctttctaattatgatgaactataatgttctgcttaacgtaatgaatttagtattttagttggctgcacttaaagaatttatatttgtaaaacactttaaaccatttgtttcacaatcagaccttttgtggattaaaaagaacaattactcttctagcccttttacagattaggaagttaaggtatctgaaggattacataaactatgtaattttactactgtctgtcactccatatcttaatgctctttctactacaaagaaaagttatctatttttacatgttttagaaatgtagatgaactcatacataatattttttgtcttttaattgatcacatactacttaggtcagaaattgtttataacagttccctttgtaatcttttaaacttttccataaatatattgatgatacttttatacaaaagctcaaagaaaaactcacttgattattttcccatttgggagttac

SEQ ID NO: 128892 - DNA, 882 bp, Homo sapiens
  Payload ID: 5209
  Gene Symbol: ELF2
  Gene Name: E74-like factor 2 (ets domain transcription factor)
  ENST ID: ENST00000420916
  CDS Start-End: 148-882
gatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagca

SEQ ID NO: 128893 - DNA, 1766 bp, Homo sapiens
  Payload ID: 5209
  Gene Symbol: ELF2
  Gene Name: E74-like factor 2 (ets domain transcription factor)
  ENST ID: ENST00000511184
  CDS Start-End: 485-766
tctgtgtcgccgccgtcgcctaggcggttgggggtcggtggggcggcgcgggcgggggtcgctgcgcggggcggcgagcctctgttttgtctccttctctccctgtggagcggctcgggctgctggggaggccccggctccctccggacgctcggccaacggcggcggctagtccgcggccctgctgagagggaaaaggacgccgcggtcttcccaggcgtcgcggagagcagttccaaagaactactggttcagattttagctcttcccaagttgtgaaaatagtgaaggatgcttagactacttaacatacaaactgctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacaggtggaatctcactctgtcacccaggctggagtgcggtggtgtgatctcggctcactgcaacctccgcctcccgggttcaagtgattctcctgcctcagcctcccaagtggctgggactacagaaatcctccctgtggcacaaaaggactcctttaattagaaaatattgttgccacagggaggtagaagatcgacatgaaaaactggggatctgaaaacgagcccctatcctaggattacctgaaggtgaaacagattgagccagaaggaagacaatgctgagaccgggtttcactgtgttagccaggatggtctcgatgtcttgacctcgtgatccacccacctcggcctcccaaagtgctgggatgacaggcgtgagccactgcgcccggccctgatacttcttatatatggtgtttgacaagtctttcaggaaaatctgaatttttttccccatatgaccttttttctgatgtgtaatagttggaaaataaaggcaggatttagaataattactgagaatgaaaaacttcttttgaagaggaaaccaagaacttggttcaagaggagaaagaaattaaaaggtggtaatttctttttgagacatttactttcttgaataaacttgacatcccccccttttttttttttatctttttctttagggacattggtctatagttagtatctaggtttacaacattaagcttttttcattttgtttggaaaaacaaggctggcagaattacatttgtttttaattccattgctaatattacatacttaggaggctatcaggtgcaagttatttacttgagacaagaagcactgattattttggctaggcttcatctgaaggcctatgttctgggaagggaggcctccataaaaaaggaagaacctttagtgacctttatccttgggaataaaagtaaagatcagaagccagtgcattcagtttaccgtcttacaaaaggagtcaagtattgtataggtcagagaccactattgtaagatcatataaatcctgtgtctaattttgtt

SEQ ID NO: 128894 - DNA, 611 bp, Homo sapiens
  Payload ID: 5209
  Gene Symbol: ELF2
  Gene Name: E74-like factor 2 (ets domain transcription factor)
  ENST ID: ENST00000512627
  CDS Start-End: 35-611
aatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccga

SEQ ID NO: 128895 - DNA, 1965 bp, Homo sapiens
  Payload ID: 5209
  Gene Symbol: ELF2
  Gene Name: E74-like factor 2 (ets domain transcription factor)
  Uniprot ID: Q15723
  ENST ID: ENST00000510408
  CDS Start-End: 136-1701
ggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaag

SEQ ID NO: 128896 - DNA, 4994 bp, Homo sapiens
  Payload ID: 5210
  Gene Symbol: ELF3
  Gene Name: E74-like factor 3 (ets domain transcription factor, epithelial-specific )
  Uniprot ID: P78545
  ENST ID: ENST00000359651
  CDS Start-End: 3193-4308
gtgctgccgtgtgggcaagctctgtggggagaggggaggccagtgggttgtttttgccatcacagaatactgggaagcccctggcatcctgctccatagctctcttcaccactatcctggaaccttctccccacccccatccccatgcctccaaggcactgacctcaaatccaagtctttctcacttatctcaagctgccagcctgtagggattccttatctcagctccatgtcagcggtgaggaagccccaagaaggcaagggagctgacagccttctcatttttctcgtacatcctcctgttcaccccgccatcccgggagccccagccagatgctcttcagggcagggagcacgtgagcagccctggggctagaagccggttctcccacattcctgggtgagggactgggtggagggtgtgcctgcctcaggctccttgggggaggccccctgaagggctggggaaaatcctactgagccccaggctctcctgcctgcactggcccagtgcgggggcgggggggcggggggatcctggacattaactctctcctaggcacctgggagcttcagagaggaagaaggtaaggtaagaagcagattctctgcgcaggactttcttagtcctcaggctatagagttaaagaaagaagtatctgtagaaggtggagtcaccttttgtttgagtaaccgtttcacccaccctggctgagggtggccaggaactccccaagttgtgcattaatggaggggggtcacacagatcctacatttttttgtttttgtttttttttttttgagacgcagtgattacaggtgtgagccaccggatcctacatttcaaatgcataaaaatctagatatgggctgggcgcagtagctcatgcctgtaatcccagcactttgggaggctgaggcaggcagatcatgaggtcaggagatcgagtccatcctggctaacatggtgaaaccccgtctctactaaaaatacagaaagccgggcatggcagcgggcgcctgtaatcccagctactcggaaagctgaggcaggagaatcgcttgaacccaggagtcagaggttgcagtgagcagagatcacgccactgcactccaacctgggcgacagagcgagactccacctcaaaacaaaataaacaaaatactagatctggaagagatcttagggattattaaattcagacaacctcattttttatagatggggaaacaagcacagactccaagggtctcatccaagatcacacagttgcagatgctggctacaagtctcctgcctcaaccacctgtattaccccattcagggtctcaagaagggtctataagacactatccattgtgtttcgggctgagtccatagagacaaccacagacatgggggactctgcccacagggaaggcaagggctctggccatggagctggatgggaagactctgaagcccgaagacattgaatcctgtgcagggaaagagcgagggttttgtgtacaacacacctgcatacctggatgtgaatctcagctccaccccttcaccaactctgtgtggcctgggcaagccattctaagggaaccctccacactgcaactttcatgtctataaaatgggaataaccatgcattccttacaggacttttttggtgtgaggattaaatgagagaatatgttgaaaagtgcttggtaaatatattaatactatgcattccctcttctttgaatgacgtgacccaggtagtcaggcttctgaccactagagggcagcagaaggtactggaaaactgggccgagtgaaccagagattagatggggtccagagagcagggatgaacttacccgtgtggattctggcaactccggcagggagggctccagcaggcgctgagggaagaactttcaagcagagccgggtctcttcaggagcgactgcagcaaccctgatgcttggatggagtccaggcaggtgatggtagtgaagaccttgccaacagagtgggcgctggagaaggagccctttagtggggaccctggggccacgactaggctggcaggcccagccagcaccaattaatccatgagtattgcccagcattgagcctggagcaccttccagcccctggccagagtcctgggtgttctgggaaaaacccctaaacctagtaactcctctccctactaggcctctttgttgctgaatctctggaatttaggggccagcagctttctgactcaggtcagccaggggttcatgttccctcacttgccctccccctgcctggcccatctctggcctggcccctgggaggaatttcctgggccagagggcagccgaaagcacagatgcccaccccagcaacgttcccgccacctgcccaggccagtgccccgtgcccaaccccagagggtgcgggatgacagactctgacaatcattaaaccagccgggcctgatttcccagcactgcctgctaagatccgggccaagtggcactgaatatgcaaatcacctggggccaggagcccagtctaaaggccaggaaatcccctccatccaatgagacaccagctcaggttactgcaggggacacactataaagccctgagctcagggaggagctccctccaggctctatttagagccgggtaggggagcgcagcggccagatacctcagcgctacctggcggaactggatttctctcccgcctgccggcctgcctgccacagccggactccgccactccggtaggattccccgcctgtcattccctagcccagctcttgggaaactgcagaggggtccagaggatttgcagttctgaacctgcacactccagtctaggatctccgagcaagagcgtaggtgtcctgagggtcaaagaacagagagagattgtctctgggaaggcagaatggccatgacgccgctagtctggctccagggccccagagatctgaggagggaagcccagctggaggctcctgtggtcctgccctggtctgagatcttggagcccttcttgaagagacggtgtccgcagagttgctgatcttcctgcccctgggggctactcttgcccagggttgggcaaagcagagtagctgggagtgtaaggagaggaccctcgtcccctcaccaacctcatcctctctccccctacccacaggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctt

SEQ ID NO: 128897 - DNA, 2044 bp, Homo sapiens
  Payload ID: 5210
  Gene Symbol: ELF3
  Gene Name: E74-like factor 3 (ets domain transcription factor, epithelial-specific )
  Uniprot ID: P78545
  ENST ID: ENST00000367283
  CDS Start-End: 243-1358
aggctctatttagagccgggtaggggagcgcagcggccagatacctcagcgctacctggcggaactggatttctctcccgcctgccggcctgcctgccacagccggactccgccactccggtaggattccccgcctgtcattccctagcccagctcttgggaaactgcagaggggtccagaggatttgcagttctgaacctgcacactccagtctaggatctccgagcaagagcgtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctt

SEQ ID NO: 128898 - DNA, 3179 bp, Homo sapiens
  Payload ID: 5210
  Gene Symbol: ELF3
  Gene Name: E74-like factor 3 (ets domain transcription factor, epithelial-specific )
  Uniprot ID: P78545
  ENST ID: ENST00000367284
  CDS Start-End: 199-1314
atgagacaccagctcaggttactgcaggggacacactataaagccctgagctcagggaggagctccctccaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaaacaaaacaaaatggagatgagtacttgctgagaaagaatgagggaaggagttggcatttgttgaaagtgtagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaa

SEQ ID NO: 128899 - DNA, 769 bp, Homo sapiens
  Payload ID: 5210
  Gene Symbol: ELF3
  Gene Name: E74-like factor 3 (ets domain transcription factor, epithelial-specific )
  ENST ID: ENST00000446188
  CDS Start-End: 72-769
ggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggaggagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactg

SEQ ID NO: 128900 - DNA, 4165 bp, Homo sapiens
  Payload ID: 5211
  Gene Symbol: ELF4
  Gene Name: E74-like factor 4 (ets domain transcription factor)
  Uniprot ID: Q99607
  ENST ID: ENST00000308167
  CDS Start-End: 381-2372
ttctcctttcgccggcgccgagttcctggcgccgctcgcccggcccggcttccgaggggagaggacgggctggcggggctggggacccgcgtctcggcccccggagcggggaccacggagacagaccccggcccggcgaccgagctgggcccgtgagccactcggcctcaggtcgctcctgtggttggtccagcccagaatgcagccttgagcctggcttaggccaccacctactccagctctctccaccccctattttactgcagctcagggggtaggctctaggctccaaagtacctgggtattgtcccttcatcaagaaagccccacagctctggagggctctgataatcccgttgtcagctctctgaaaagacagcatggctattaccctacagcccagtgacctgatctttgagttcgcaagcaacgggatggatgatgatatccaccagctggaagacccctctgtgttcccagctgtgatcgtggagcaggtaccctaccctgatttactgcatctgtactcgggactggagttggacgacgttcacaatggcatcataacagacgggaccttgtgcatgacgcaggatcagatcctggaaggcagttttttgctgacagatgacaatgaggccacctcgcacaccatgtcaaccgcggaagtcttactcaatatggagtctcccagcgatatcctggatgagaagcagatcttcagtacctccgaaatgcttccagactcggaccctgcaccagctgtcactctgcccaactacctgtttcctgcctctgagcccgatgccctgaacagggcgggtgacactagtgaccaggaggggcattctctggaggagaaggcctccagagaggaaagtgccaagaagactgggaaatcaaagaagagaatccggaagaccaagggcaaccgaagtacctcacctgtcactgaccccagcatccccattaggaagaaatcaaaggatggcaaaggcagcaccatctatctgtgggagttcctcctggctcttctgcaagacagaaacacctgtcccaagtacatcaagtggacccagcgagagaaaggcatcttcaaactggtggactccaaagctgtgtccaagctgtgggggaagcagaaaaacaagcctgacatgaactatgagacaatggggcgggcactaagatactactaccaaagaggcatactggccaaagtggaagggcagaggctggtgtaccagtttaaggagatgcccaaggacctggtggtcattgaagatgaggatgagagcagcgaagccacagcagccccacctcaggcctccacggcctctgtggcctctgccagtaccacccggcgaaccagctccagggtctcatccagatctgccccccagggcaagggcagctcttcttgggagaagccaaaaattcagcatgtcggtctccagccatctgcgagtctggaattgggaccgtcgctagacgaggagatccccactacctccaccatgctcgtctctccagcagagggccaggtcaagctcaccaaagctgtgagtgcatcttcagtgcccagcaacatccacctaggagtggcccccgtggggtcgggctcggccctgaccctgcagacgatcccactgaccacggtgctgaccaatgggcctcctgccagtactactgctcccactcagctcgttctccagagtgttccagcggcctctactttcaaggacaccttcactttgcaggcctctttccccctgaacgccagtttccaagacagccaggtggcagccccaggggctccactgattctcagtggcctcccccaacttctggctggggccaaccgtccgaccaacccggcgccacccacggtcacaggggctggaccagcagggcccagctctcagccccctgggactgtcattgctgccttcatcaggacttctggcactacagcagcccctagggtcaaggaggggccactgaggtcctcctcctatgttcagggtatggtgacgggggcccccatggaggggctgctggttcctgaagagaccctgagggagctcctgagagatcaggctcatcttcagccacttccaacccaggtggtttccaggggttcccacaatccgagccttctgggcaaccagactttgtctcctcccagccgccccactgttgggctgaccccagtggctgaacttgagctctcctcaggctcagggtccctgctgatggctgagcctagtgtgaccacatctgggagccttctgacaagatcccccaccccagcccctttctccccattcaaccctacttccctcattaagatggagccccatgacatataagcaaaggggtcagggcaagtgtgacccaccaggcaaaattgagcagcattttcatagggaccgacttcagtagcacacctgcccctgcatttcagtgggatgtcaatacacttgaccccaagtcccccggccctgcctggtgtcactgtggccaaacagtgcccagcttaagcatccctggcatcagactatggccttcaagagcactagggcatatgcttttggcagcataacgggctgacttggtgatggagggaaaaagccttgagccaggcagaagtttgtggccagggtttgtgcagcagctttgtgagaagagcccttctacctggctctatctcactggctgcattccctacacagggaatttactaccctatatgtgaatatccctgtatgtacttgtgtgtacttgttggtctgtatcttagtttctttggggaggacagggctgtagctgtgaggtcttgtctccaagggtgtgtgtatgtctccgtggatcagccacagggatagggattttgtttttaagggaaagcattctctaattccctttgttcatgccgagattcagttgctctgagactatggggtacaagtttgatcctccgaatctggagatgttgtagagctggaacgagtgcagagtaggaacgctttgatgcgcatgcacattggggaagatgcgctcctcagggacacaaaggccgagtggggtaaaaccacgaagggagggaagggaagtcagctctgggagcagccctcactggctggaccaaggtactcttcctggagtttgccgtgttagcaaccacagtcaccttgcagtcaggctggaatcttgggccaccccaaagtgctttgctgaaggatttagacggggatgaagtgccctccagcctcagagctagccacaaagcccccagagctgaattcattgagtatttgtgcctagggcttgggctgtttgtgtgataccggccccccgccagacaatagcctttgctgacaccccagcctacttccccgatcctgggctccctcttgattactttttgacattttccagctgtcaggcatcactgcggctagtccggcagcgacctagatggggtccacccccattcctgctcaagcatgggcacctaccacatggtttctgctgctcagcctgcctgcaactcacctcgaaggcggaccagcctgcctctgtgatgactgcagcagacctccttgggtgtaccaatgcccctcatctcccactttcacacctaaccctgactccttcaccaagaagacgggagtcggcagccaggagttcccgtggcacctctctctcttcgtggctccctgcttcccccttccctctttccgaggaagggtcaacctattctctctcaaagccaacccctaggccaattgcctggatctcctcccctctcccttctttaaacgagcttgcctccctcctgccaagtttgagggcaaggctaagaaatgtcagccacggaaacaactctattatctggtgactttgggtaatgtgaatcagtgcctgaggacctttgctgtgtccttggtacagaaccatccacttgacctaactacctcccctggccgcgctctcgctcttctcttctttgttaagccaacaactatcaccctctcctactcttcttctccctgccccctggagggcactgtgtttggttgtgcaaatgtatttactatgcgtgtttccagcagttggcattaaagtgcctttttctaataaaatcagtttattatgacag

SEQ ID NO: 128901 - DNA, 4145 bp, Homo sapiens
  Payload ID: 5211
  Gene Symbol: ELF4
  Gene Name: E74-like factor 4 (ets domain transcription factor)
  Uniprot ID: Q99607
  ENST ID: ENST00000335997
  CDS Start-End: 307-2298
ggtatttgcatctctccctccaacttgccattggcggcgcgaagtgtgggagagccctgcgcctcgcccgcccggaccagcctgccccggcgccgaggtcgctcctgtggttggtccagcccagaatgcagccttgagcctggcttaggccaccacctactccagctctctccaccccctattttactgcagctcagggggtaggctctaggctccaaagtacctgggtattgtcccttcatcaagaaagccccacagctctggagggctctgataatcccgttgtcagctctctgaaaagacagcatggctattaccctacagcccagtgacctgatctttgagttcgcaagcaacgggatggatgatgatatccaccagctggaagacccctctgtgttcccagctgtgatcgtggagcaggtaccctaccctgatttactgcatctgtactcgggactggagttggacgacgttcacaatggcatcataacagacgggaccttgtgcatgacgcaggatcagatcctggaaggcagttttttgctgacagatgacaatgaggccacctcgcacaccatgtcaaccgcggaagtcttactcaatatggagtctcccagcgatatcctggatgagaagcagatcttcagtacctccgaaatgcttccagactcggaccctgcaccagctgtcactctgcccaactacctgtttcctgcctctgagcccgatgccctgaacagggcgggtgacactagtgaccaggaggggcattctctggaggagaaggcctccagagaggaaagtgccaagaagactgggaaatcaaagaagagaatccggaagaccaagggcaaccgaagtacctcacctgtcactgaccccagcatccccattaggaagaaatcaaaggatggcaaaggcagcaccatctatctgtgggagttcctcctggctcttctgcaagacagaaacacctgtcccaagtacatcaagtggacccagcgagagaaaggcatcttcaaactggtggactccaaagctgtgtccaagctgtgggggaagcagaaaaacaagcctgacatgaactatgagacaatggggcgggcactaagatactactaccaaagaggcatactggccaaagtggaagggcagaggctggtgtaccagtttaaggagatgcccaaggacctggtggtcattgaagatgaggatgagagcagcgaagccacagcagccccacctcaggcctccacggcctctgtggcctctgccagtaccacccggcgaaccagctccagggtctcatccagatctgccccccagggcaagggcagctcttcttgggagaagccaaaaattcagcatgtcggtctccagccatctgcgagtctggaattgggaccgtcgctagacgaggagatccccactacctccaccatgctcgtctctccagcagagggccaggtcaagctcaccaaagctgtgagtgcatcttcagtgcccagcaacatccacctaggagtggcccccgtggggtcgggctcggccctgaccctgcagacgatcccactgaccacggtgctgaccaatgggcctcctgccagtactactgctcccactcagctcgttctccagagtgttccagcggcctctactttcaaggacaccttcactttgcaggcctctttccccctgaacgccagtttccaagacagccaggtggcagccccaggggctccactgattctcagtggcctcccccaacttctggctggggccaaccgtccgaccaacccggcgccacccacggtcacaggggctggaccagcagggcccagctctcagccccctgggactgtcattgctgccttcatcaggacttctggcactacagcagcccctagggtcaaggaggggccactgaggtcctcctcctatgttcagggtatggtgacgggggcccccatggaggggctgctggttcctgaagagaccctgagggagctcctgagagatcaggctcatcttcagccacttccaacccaggtggtttccaggggttcccacaatccgagccttctgggcaaccagactttgtctcctcccagccgccccactgttgggctgaccccagtggctgaacttgagctctcctcaggctcagggtccctgctgatggctgagcctagtgtgaccacatctgggagccttctgacaagatcccccaccccagcccctttctccccattcaaccctacttccctcattaagatggagccccatgacatataagcaaaggggtcagggcaagtgtgacccaccaggcaaaattgagcagcattttcatagggaccgacttcagtagcacacctgcccctgcatttcagtgggatgtcaatacacttgaccccaagtcccccggccctgcctggtgtcactgtggccaaacagtgcccagcttaagcatccctggcatcagactatggccttcaagagcactagggcatatgcttttggcagcataacgggctgacttggtgatggagggaaaaagccttgagccaggcagaagtttgtggccagggtttgtgcagcagctttgtgagaagagcccttctacctggctctatctcactggctgcattccctacacagggaatttactaccctatatgtgaatatccctgtatgtacttgtgtgtacttgttggtctgtatcttagtttctttggggaggacagggctgtagctgtgaggtcttgtctccaagggtgtgtgtatgtctccgtggatcagccacagggatagggattttgtttttaagggaaagcattctctaattccctttgttcatgccgagattcagttgctctgagactatggggtacaagtttgatcctccgaatctggagatgttgtagagctggaacgagtgcagagtaggaacgctttgatgcgcatgcacattggggaagatgcgctcctcagggacacaaaggccgagtggggtaaaaccacgaagggagggaagggaagtcagctctgggagcagccctcactggctggaccaaggtactcttcctggagtttgccgtgttagcaaccacagtcaccttgcagtcaggctggaatcttgggccaccccaaagtgctttgctgaaggatttagacggggatgaagtgccctccagcctcagagctagccacaaagcccccagagctgaattcattgagtatttgtgcctagggcttgggctgtttgtgtgataccggccccccgccagacaatagcctttgctgacaccccagcctacttccccgatcctgggctccctcttgattactttttgacattttccagctgtcaggcatcactgcggctagtccggcagcgacctagatggggtccacccccattcctgctcaagcatgggcacctaccacatggtttctgctgctcagcctgcctgcaactcacctcgaaggcggaccagcctgcctctgtgatgactgcagcagacctccttgggtgtaccaatgcccctcatctcccactttcacacctaaccctgactccttcaccaagaagacgggagtcggcagccaggagttcccgtggcacctctctctcttcgtggctccctgcttcccccttccctctttccgaggaagggtcaacctattctctctcaaagccaacccctaggccaattgcctggatctcctcccctctcccttctttaaacgagcttgcctccctcctgccaagtttgagggcaaggctaagaaatgtcagccacggaaacaactctattatctggtgactttgggtaatgtgaatcagtgcctgaggacctttgctgtgtccttggtacagaaccatccacttgacctaactacctcccctggccgcgctctcgctcttctcttctttgttaagccaacaactatcaccctctcctactcttcttctccctgccccctggagggcactgtgtttggttgtgcaaatgtatttactatgcgtgtttccagcagttggcattaaagtgcctttttctaataaaatcagtttattatgacagtttcctgatggttgaaagtaagcatcttgataaagggtcaccattaaaaaaaaa

SEQ ID NO: 128902 - DNA, 406 bp, Homo sapiens
  Payload ID: 5211
  Gene Symbol: ELF4
  Gene Name: E74-like factor 4 (ets domain transcription factor)
  ENST ID: ENST00000434609
  CDS Start-End: 177-406
ggcgaccgagctgggcccgtgagccactcggcctcaggtcgctcctgtggttggtccagcccagaatgcagccttgagcctggcttaggccaccacctactccagctctctccaccccctattttactgcagctcaggggcccagtgacctgatctttgagttcgcaagcaacgggatggatgatgatatccaccagctggaagacccctctgtgttcccagctgtgatcgtggagcaggtaccctaccctgatttactgcatctgtactcgggactggagttggacgacgttcacaatggcatcataacagacgggaccttgtgcatgacgcaggatcagatcctggaaggcagttttttgctgacagatgacaatgaggccacctcgcacaccatgtcaaccgc

SEQ ID NO: 128903 - DNA, 3878 bp, Homo sapiens
  Payload ID: 5211
  Gene Symbol: ELF4
  Gene Name: E74-like factor 4 (ets domain transcription factor)
  ENST ID: ENST00000615377
  CDS Start-End: 103-2091
gctctaggctccaaagtacctgggtattgtcccttcatcaagaaagccccacagctctggagggctctgataatcccgttgtcagctctctgaaaagacagcatggctattaccctacagcccagtgacctgatctttgagttcgcaagcaacgggatggatgatgatatccaccagctggaagacccctctgtgttcccagctgtgatcgtggagcaggtaccctaccctgatttactgcatctgtactcgggactggagttggacgacgttcacaatggcatcataacagacgggaccttgtgcatgacgcaggatcagatcctggaaggcagttttttgctgacagatgacaatgaggccacctcgcacaccatgtcaaccgcggaagtcttactcaatatggagtctcccagcgatatcctggatgagaagcagatcttcagtacctccgaaatgcttccagactcggaccctgcaccagctgtcactctgcccaactacctgtttcctgcctctgagcccgatgccctgaacagggcgggtgacactagtgaccaggaggggcattctctggaggagaaggcctccagagaggaaagtgccaagaagactgggaaatcaaagaagagaatccggaagaccaagggcaaccgaagtacctcacctgtcactgaccccagcatccccattaggaagaaatcaaaggatggcaaaggcagcaccatctatctgtgggagttcctcctggctcttctgcaagacagaaacacctgtcccaagtacatcaagtggacccagcgagagaaaggcatcttcaaactggtggactccaaagctgtgtccaagctgtgggggaagcagaaaaacaagcctgacatgaactatgagacaatggggcgggcactaagatactactaccaaagaggcatactggccaaagtggaagggcagaggctggtgtaccagtttaaggagatgcccaaggacctggtggtcattgaagatgaggatgagagcagcgaagccacagcagccccacctcaggcctccacggcctctgtggcctctgccagtaccacccggcgaaccagctccagggtcatccagatctgccccccagggcaagggcagctcttcttgggagaagccaaaaattcagcatgtcggtctccagccatctgcgagtctggaattgggaccgtcgctagacgaggagatccccactacctccaccatgctcgtctctccagcagagggccaggtcaagctcaccaaagctgtgagtgcatcttcagtgcccagcaacatccacctaggagtggcccccgtgggtcgggctcggccctgaccctgcagacgatcccactgaccacggtgctgaccaatgggcctcctgccagtactactgctcccactcagctcgttctccagagtgttccagcggcctctactttcaaggacaccttcactttgcaggcctctttccccctgaacgccagtttccaagacagccaggtggcagccccaggggctccactgattctcagtggcctcccccaacttctggctggggccaaccgtccgaccaacccggcgccacccacggtcacaggggctggaccagcagggcccagctctcagccccctgggactgtcattgctgccttcatcaggacttctggcactacagcagcccctagggtcaaggaggggccactgaggtcctcctcctatgttcagggtatggtgacgggggcccccatggaggggctgctggttcctgaagagaccctgagggagctcctgagagatcaggctcatcttcagccacttccaacccaggtggtttccaggggttcccacaatccgagccttctgggcaaccagactttgtctcctcccagccgccccactgttgggctgaccccagtggctgaacttgagctctcctcaggctcagggtccctgctgatggctgagcctagtgtgaccacatctgggagccttctgacaagatcccccaccccagcccctttctccccattcaaccctacttccctcattaagatggagccccatgacatataagcaaaggggtcagggcaagtgtgacccaccaggcaaaattgagcagcattttcatagggaccgacttcagtagcacacctgcccctgcatttcagtgggatgtcaatacacttgaccccaagtcccccggccctgcctggtgtcactgtggccaaacagtgcccagcttaagcatccctggcatcagactatggccttcaagagcactagggcatatgcttttggcagcataacgggctgacttggtgatggagggaaaaagccttgagccaggcagaagtttgtggccagggtttgtgcagcagctttgtgagaagagcccttctacctggctctatctcactggctgcattccctacacagggaatttactaccctatatgtgaatatccctgtatgtacttgtgtgtacttgttggtctgtatcttagtttctttggggaggacagggctgtagctgtgaggtcttgtctccaagggtgtgtgtatgtctccgtggatcagccacagggatagggattttgtttttaagggaaagcattctctaattccctttgttcatgccgagattcagttgctctgagactatggggtacaagtttgatcctccgaatctggagatgttgtagagctggaacgagtgcagagtaggaacgctttgatgcgcatgcacattggggaagatgcgctcctcagggacacaaaggccgagtggggtaaaaccacgaagggagggaagggaagtcagctctgggagcagccctcactggctggaccaaggtactcttcctggagtttgccgtgttagcaaccacagtcaccttgcagtcaggctggaatcttgggccaccccaaagtgctttgctgaaggatttagacggggatgaagtgccctccagcctcagagctagccacaaagcccccagagctgaattcattgagtatttgtgcctagggcttgggctgtttgtgtgataccggccccccgccagacaatagcctttgctgacaccccagcctacttccccgatcctgggctccctcttgattactttttgacattttccagctgtcaggcatcactgcggctagtccggcagcgacctagatggggtccacccccattcctgctcaagcatgggcacctaccacatggtttctgctgctcagcctgcctgcaactcacctcgaaggcggaccagcctgcctctgtgatgactgcagcagacctccttgggtgtaccaatgcccctcatctcccactttcacacctaaccctgactccttcaccaagaagacgggagtcggcagccaggagttcccgtggcacctctctctcttcgtggctccctgcttcccccttccctctttccgaggaagggtcaacctattctctctcaaagccaacccctaggccaattgcctggatctcctcccctctcccttctttaaacgagcttgcctccctcctgccaagtttgagggcaaggctaagaaatgtcagccacggaaacaactctattatctggtgactttgggtaatgtgaatcagtgcctgaggacctttgctgtgtccttggtacagaaccatccacttgacctaactacctcccctggccgcgctctcgctcttctcttctttgttaagccaacaactatcaccctctcctactcttcttctccctgccccctggagggcactgtgtttggttgtgcaaatgtatttactatgcgtgtttccagcagttggcattaaagtgcctttttctaataaaatcagtttatta

SEQ ID NO: 128904 - DNA, 2321 bp, Homo sapiens
  Payload ID: 5212
  Gene Symbol: ELF5
  Gene Name: E74-like factor 5 (ets domain transcription factor)
  Uniprot ID: Q9UKW6
  ENST ID: ENST00000257832
  CDS Start-End: 129-896
gtaggtgtcacttatatcacaaggctacaggtgtctttatttccactgcacgctggtgctgggagcgcctgccttctcttgccttgaaagcctcctctttggacctagccaccgctgccctcacggtaatgttggactcggtgacacacagcaccttcctgcctaatgcatccttctgcgatcccctgatgtcgtggactgatctgttcagcaatgaagagtactaccctgcctttgagcatcagacagcctgtgactcatactggacatcagtccaccctgaatactggactaagcgccatgtgtgggagtggctccagttctgctgcgaccagtacaagttggacaccaattgcatctccttctgcaacttcaacatcagtggcctgcagctgtgcagcatgacacaggaggagttcgtcgaggcagctggcctctgcggcgagtacctgtacttcatcctccagaacatccgcacacaaggttactccttttttaatgacgctgaagaaagcaaggccaccatcaaagactatgctgattccaactgcttgaaaacaagtggcatcaaaagtcaagactgtcacagtcatagtagaacaagcctccaaagttctcatctatgggaatttgtacgagacctgcttctatctcctgaagaaaactgtggcattctggaatgggaagatagggaacaaggaatttttcgggtggttaaatcggaagccctggcaaagatgtggggacaaaggaagaaaaatgacagaatgacatatgaaaagttgagcagagccctgagatactactataaaacaggaattttggagcgggttgaccgaaggttagtgtacaaatttggaaaaaatgcacacgggtggcaggaagacaagctatgatctgctccaggcatcaagctcattttatggatttctgtcttttaaaacaatcagattgcaatagacattcgaaaggcttcattttcttctctttttttttaacctgcaaacatgctgataaaatttctccacatctcagcttacatttggattcagagttgttgtctatggagggtgagagcagaaactcttaagaaatcctttcttctccctaaggggatgaggggatgatcttttgtggtgtcttgatcaaactttattttcctagagttgtggaatgacaacagcccatgccattgatgctgatcagagaaaaactattcaattctgccattagagacacatccaatgctcccatcccaaaggttcaaaagttttcaaataactgtggcagctcaccaaaggtgggggaaagcatgattagtttgcaggttatggtaggagagggtgagatataagacatacatactttagattttaaattattaaagtcaaaaatccatagaaaagtatccctttttttttttttgagacgggttctcactatgttgcccagggctggtcttgaactcctatgctcaagtgatcctcccacctcagcctcccaaagtactgtgattacaagcgtgagccacggcacctgggcagaaaagtatcttaattaatgaaagagctaagccatcaagctgggacttaattggatttaacataggttcacagaaagtttcctaaccagagcatctttttgaccactcagcaaaacttccacagacatccttctggacttaaacacttaacattaaccacattattaattgttgctgagtttattcccccttctaactgatggctggcatctgatatgcagagttagtcaacagacactggcatcaattacaaaatcactgctgtttctgtgattcaagctgtcaacacaataaaatcgaaattcattgattccatctcaggtccagatgttaaacgtttataaaaccggaaatgtcctaacaactctgtaatggcaaattaaattgtgtgtcttttttgttttgtctttctacctgatgtgtattcaagcgctataacacgtatttccttgacaaaaatagtgacagtgaattcacactaataaatgttcataggttaaagtctgcactgacattttctcatcaatcactggtatgtaagttatcagtgactgacagctaggtggactgcccctaggacttctgtttcaccagagcaggaatcaagtggtgaggcactgaatcgctgtacaggctgaagacctccttattagagttgaacttcaaagtaacttgttttaaaaaatatgaattactgtaaaataatctattttggattcatgtgttttccaggtggatatagtttgtaaacaatgtgaataaagtatttaacatgttc

SEQ ID NO: 128905 - DNA, 2450 bp, Homo sapiens
  Payload ID: 5212
  Gene Symbol: ELF5
  Gene Name: E74-like factor 5 (ets domain transcription factor)
  Uniprot ID: Q9UKW6
  ENST ID: ENST00000312319
  CDS Start-End: 231-1028
ggctgagtggtttgctccttcccctctctctgggaggctgagcaggggtgccgggttgctcaggccatgggagccacacctgttattgctgcctctgatttgtgtgacactgagaagcccacaggcctgtccctccaactcggtggaccctctctgtgtgcatttggtgtgtgagccagctctgagaagggttcagaagccactggaggcatctggggacctcagcttccatgccatctctgcctcactcccacagggtaatgttggactcggtgacacacagcaccttcctgcctaatgcatccttctgcgatcccctgatgtcgtggactgatctgttcagcaatgaagagtactaccctgcctttgagcatcagacagcctgtgactcatactggacatcagtccaccctgaatactggactaagcgccatgtgtgggagtggctccagttctgctgcgaccagtacaagttggacaccaattgcatctccttctgcaacttcaacatcagtggcctgcagctgtgcagcatgacacaggaggagttcgtcgaggcagctggcctctgcggcgagtacctgtacttcatcctccagaacatccgcacacaaggttactccttttttaatgacgctgaagaaagcaaggccaccatcaaagactatgctgattccaactgcttgaaaacaagtggcatcaaaagtcaagactgtcacagtcatagtagaacaagcctccaaagttctcatctatgggaatttgtacgagacctgcttctatctcctgaagaaaactgtggcattctggaatgggaagatagggaacaaggaatttttcgggtggttaaatcggaagccctggcaaagatgtggggacaaaggaagaaaaatgacagaatgacatatgaaaagttgagcagagccctgagatactactataaaacaggaattttggagcgggttgaccgaaggttagtgtacaaatttggaaaaaatgcacacgggtggcaggaagacaagctatgatctgctccaggcatcaagctcattttatggatttctgtcttttaaaacaatcagattgcaatagacattcgaaaggcttcattttcttctctttttttttaacctgcaaacatgctgataaaatttctccacatctcagcttacatttggattcagagttgttgtctatggagggtgagagcagaaactcttaagaaatcctttcttctccctaaggggatgaggggatgatcttttgtggtgtcttgatcaaactttattttcctagagttgtggaatgacaacagcccatgccattgatgctgatcagagaaaaactattcaattctgccattagagacacatccaatgctcccatcccaaaggttcaaaagttttcaaataactgtggcagctcaccaaaggtgggggaaagcatgattagtttgcaggttatggtaggagagggtgagatataagacatacatactttagattttaaattattaaagtcaaaaatccatagaaaagtatccctttttttttttttgagacgggttctcactatgttgcccagggctggtcttgaactcctatgctcaagtgatcctcccacctcagcctcccaaagtactgtgattacaagcgtgagccacggcacctgggcagaaaagtatcttaattaatgaaagagctaagccatcaagctgggacttaattggatttaacataggttcacagaaagtttcctaaccagagcatctttttgaccactcagcaaaacttccacagacatccttctggacttaaacacttaacattaaccacattattaattgttgctgagtttattcccccttctaactgatggctggcatctgatatgcagagttagtcaacagacactggcatcaattacaaaatcactgctgtttctgtgattcaagctgtcaacacaataaaatcgaaattcattgattccatctcaggtccagatgttaaacgtttataaaaccggaaatgtcctaacaactctgtaatggcaaattaaattgtgtgtcttttttgttttgtctttctacctgatgtgtattcaagcgctataacacgtatttccttgacaaaaatagtgacagtgaattcacactaataaatgttcataggttaaagtctgcactgacattttctcatcaatcactggtatgtaagttatcagtgactgacagctaggtggactgcccctaggacttctgtttcaccagagcaggaatcaagtggtgaggcactgaatcgctgtacaggctgaagacctccttattagagttgaacttcaaagtaacttgttttaaaaaatatgaattactgtaaaataatctattttggattcatgtgttttccaggtggatatagtttgtaaacaatgtgaataaagtatttaacatg

SEQ ID NO: 128906 - DNA, 637 bp, Homo sapiens
  Payload ID: 5212
  Gene Symbol: ELF5
  Gene Name: E74-like factor 5 (ets domain transcription factor)
  Uniprot ID: Q9UKW6
  ENST ID: ENST00000429939
  CDS Start-End: 134-616
tgtctgtaggtgtcacttatatcacaaggctacaggtgtctttatttccactgcacgctggtgctgggagcgcctgccttctcttgccttgaaagcctcctctttggacctagccaccgctgccctcacggtaatgttggactcggtgacacacagcaccttcctgcctaatgcatccttctgcgatcccctgatgtcgtggactgatctgttcagcaatgaagagtactaccctgcctttgagcatcagacagatgctgattccaactgcttgaaaacaagtggcatcaaaagtcaagactgtcacagtcatagtagaacaagcctccaaagttctcatctatgggaatttgtacgagacctgcttctatctcctgaagaaaactgtggcattctggaatgggaagatagggaacaaggaatttttcgggtggttaaatcggaagccctggcaaagatgtggggacaaaggaagaaaaatgacagaatgacatatgaaaagttgagcagagccctgagatactactataaaacaggaattttggagcgggttgaccgaaggttagtgtacaaatttggaaaaaatgcacacgggtggcaggaagacaagctatgatctgctccaggcatcaagctc

SEQ ID NO: 128907 - DNA, 2330 bp, Homo sapiens
  Payload ID: 5212
  Gene Symbol: ELF5
  Gene Name: E74-like factor 5 (ets domain transcription factor)
  Uniprot ID: Q9UKW6
  ENST ID: ENST00000532417
  CDS Start-End: 94-510
tttatttccactgcacgctggtgctgggagcgcctgccttctcttgccttgaaagcctcctctttggacctagccaccgctgccctcacggtaatgttggactcggtgacacacagcaccttcctgcctaatgcatccttctgcgatcccctgatgtcgtggactgatctgttcagcaatgaagagtactaccctgcctttgagcatcagacagcctgtgactcatactggacatcagtccaccctgaatactggactaagcgccatgtgtgggagtggctccagttctgctgcgaccagtacaagttggacaccaattgcatctccttctgcaacttcaacatcagtggcctgcagctgtgcagcatgacacaggaggagttcgtcgaggcagctggcctctgcggcgagtacctgtacttcatcctccagaacatccgcacacaaggtcagtgttcagagggccagacctccaggggagggaccaggattaggaccaaacaactttgagaagtcctttcccatcgtgtgaattgcacagcaaaattttactaactggagttctcgttaatccaaaccttcaataactggaagctagtatgccagaattggggattttagggaaaagggagcgagttacaaaaatgcaaattgagtgcatttaaaaaaagagaaagaaaaacggacaccacgttcagggactgcccaggcaccaggctgataataatacagtatattcataatgatttgaaaccacacaggatggacaaaaaagaggtttgtgcttcatctctcattaagcagaagaggaataaaattaaatagactaccttcccttttctacaggagtccaactaattatcatttcatcacattcctaatggtcaaggatcaagtggccagaaggtggcgccaatagcattatttaactcttcaacaggccttttgcatgcagaatgtcgatgaacattttttcaatccagaaaggttctttgagaacatcgagctctaatgtctcaaagtcacacatagataaaggaactgatatcctgagacattaagtgacttcctcaaggtcacacagcaaacagggctgattcacagaaagtcagtacaaagcaagggcttggagatccgaaagacctgtgttccaaccctggctccaatactccgagctacggaacctctggcgagtggcttaagctgtctgaatccccactgcctcatctgtccaatgggataatgacacctccatgggctttttgagaggattcagggaaatattacctagaacagcatatgaagatggaaatgcagtaaatggcagctgtttttccatcatcattaatataatcaagaggcatattataggatgttaaaggaagcctatctcagctcagttttaagaaggatctttttaaaggttagtaccttcttttgaaaaggtaattcagaagatacaggagataggacgatccccaccactggagataatcaagtagtctaatagccccctgcttgaagaggaggatatgacagcgcctcttgtttgcacagaaaaaccacagaggaccctcctgctctgtgattctttggcctcctcttgatcctcatccatcatgagcgcttgaaggcagaaaagctaagaatggtggcccttgggcactacatggctggggccctgggagccaaaactccagtgacaatgacctgccaagagctgggatctgtgtcctgtgctcagagtgggcactccctgaaagaggacaagtttgaccaagtcacaacggctccagaagaaggagcttgggactccatttaggatcctcccaagggaacaggctcgcacaaaaatcctagggccacagagaggggtgtattttattctggaaaaagatgcagtttggcaatgccagcttggccaaatgtcaagtcaacctcatttgtctccatgctcttgtgcagcccctgtgctggcatctcccaccacaagcacctctcttccctggcaatggttgcatcaaaaaacaaacaaacaaaaaaaacctgttggccaggcacagttgctcaggcctgtaatcccaatactttgggaggctgaggcaggcagatcatctaaggtcaggaattcgagacaagcctggccaacatggtgaaaccccgtctctactaaaaatacaaaattagacaggcatggtggtgcgtgcctataatcccagttactcaggaggctgaggcatgagaatcacttgaacccaggaggtggaggttgcaagtgagccgagattgcaccattgcactccagcctgggcaaaaagagcaaaatcctg

SEQ ID NO: 128908 - DNA, 2217 bp, Homo sapiens
  Payload ID: 5212
  Gene Symbol: ELF5
  Gene Name: E74-like factor 5 (ets domain transcription factor)
  ENST ID: ENST00000620316
  CDS Start-End: 231-794
ggctgagtggtttgctccttcccctctctctgggaggctgagcaggggtgccgggttgctcaggccatgggagccacacctgttattgctgcctctgatttgtgtgacactgagaagcccacaggcctgtccctccaactcggtggaccctctctgtgtgcatttggtgtgtgagccagctctgagaagggttcagaagccactggaggcatctggggacctcagcttccatgccatctctgcctcactcccacagggtaatgttggactcggtgacacacagcaccttcctgcctaatgcatccttctgcgatcccctgatgtcgtggactgatctgttcagcaatgaagagtactaccctgcctttgagcatcagacaggttactccttttttaatgacgctgaagaaagcaaggccaccatcaaagactatgctgattccaactgcttgaaaacaagtggcatcaaaagtcaagactgtcacagtcatagtagaacaagcctccaaagttctcatctatgggaatttgtacgagacctgcttctatctcctgaagaaaactgtggcattctggaatgggaagatagggaacaaggaatttttcgggtggttaaatcggaagccctggcaaagatgtggggacaaaggaagaaaaatgacagaatgacatatgaaaagttgagcagagccctgagatactactataaaacaggaattttggagcgggttgaccgaaggttagtgtacaaatttggaaaaaatgcacacgggtggcaggaagacaagctatgatctgctccaggcatcaagctcattttatggatttctgtcttttaaaacaatcagattgcaatagacattcgaaaggcttcattttcttctctttttttttaacctgcaaacatgctgataaaatttctccacatctcagcttacatttggattcagagttgttgtctatggagggtgagagcagaaactcttaagaaatcctttcttctccctaaggggatgaggggatgatcttttgtggtgtcttgatcaaactttattttcctagagttgtggaatgacaacagcccatgccattgatgctgatcagagaaaaactattcaattctgccattagagacacatccaatgctcccatcccaaaggttcaaaagttttcaaataactgtggcagctcaccaaaggtgggggaaagcatgattagtttgcaggttatggtaggagagggtgagatataagacatacatactttagattttaaattattaaagtcaaaaatccatagaaaagtatccctttttttttttttgagacgggttctcactatgttgcccagggctggtcttgaactcctatgctcaagtgatcctcccacctcagcctcccaaagtactgtgattacaagcgtgagccacggcacctgggcagaaaagtatcttaattaatgaaagagctaagccatcaagctgggacttaattggatttaacataggttcacagaaagtttcctaaccagagcatctttttgaccactcagcaaaacttccacagacatccttctggacttaaacacttaacattaaccacattattaattgttgctgagtttattcccccttctaactgatggctggcatctgatatgcagagttagtcaacagacactggcatcaattacaaaatcactgctgtttctgtgattcaagctgtcaacacaataaaatcgaaattcattgattccatctcaggtccagatgttaaacgtttataaaaccggaaatgtcctaacaactctgtaatggcaaattaaattgtgtgtcttttttgttttgtctttctacctgatgtgtattcaagcgctataacacgtatttccttgacaaaaatagtgacagtgaattcacactaataaatgttcataggttaaagtctgcactgacattttctcatcaatcactggtatgtaagttatcagtgactgacagctaggtggactgcccctaggacttctgtttcaccagagcaggaatcaagtggtgaggcactgaatcgctgtacaggctgaagacctccttattagagttgaacttcaaagtaacttgttttaaaaaatatgaattactgtaaaataatctattttggattcatgtgttttccaggtggatatagtttgtaaacaatgtgaataaagtatttaacatgt

SEQ ID NO: 128909 - DNA, 5250 bp, Homo sapiens
  Payload ID: 5213
  Gene Symbol: EBF1
  Gene Name: early B-cell factor 1
  Uniprot ID: Q9UH73
  ENST ID: ENST00000313708
  CDS Start-End: 284-2059
gccaagcatacatctctaattttattattttggtcttttcgttggattttccctttcttctttttttcgggttatcgctcagttttgagcagaggtttacattttttaaaaatttgctttccagcccgccttgatcttctaagtgcgagttcatcgtctgagaaaaaaaaaaatctctggttggcgtttttgtttcttttcttttctttcttttctttcctttttttttttttttaatttttttcaagggggaggagattttccacaagaaaaggttgttttcatgtttgggattcaggaaagcatccaacggagtggaagcagcatgaaggaagagccgctgggcagcggcatgaacgcggtgcggacgtggatgcagggcgccggggtgctggacgccaacacggcggcgcagagcggggtgggtctggcccgggctcactttgagaagcagccgccttccaatctgcggaaatccaacttcttccacttcgtcctggccctctacgacagacagggccagcccgtggagatcgagaggacagcgtttgtggggttcgtggagaaggaaaaagaagccaacagcgaaaagaccaataacggaattcactaccggcttcagcttctctacagcaatgggataaggacggagcaggatttctacgtgcgcctcattgactccatgacaaaacaagccatagtgtatgaaggccaagacaagaacccagaaatgtgccgagtcttgctcacacatgagatcatgtgcagccgctgttgtgacaagaaaagctgtggcaaccgaaatgagactccctcagatccagtgataattgacaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaaggtacgccctcttatctggaacatgctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaaagaaaaaaaggaaaaaaaaaaaagcttgtatgggacagaataggaatgccagttagattttttagaaaaactaagggtcggcttttgcgccttaaagcatatcaaatggtagttagctcagacagtgcattttcaatatctaacttaacatgccaccccttagcagtgcaagcttatttatctcttttgtattgttgtcttaagcaactgtgtaaataaatgcagcctggaaagttaaaacgcgatgtaagtgatcacatttttccctctactcgaaaatccagtgcctctagacagattgttaaaactgcatatttaaatctgatctcattctctccttttacttaagtcagtttcttctgaagccgatggcctctcgagagcttggtggcacacatactgtgtgagaatctcctttgagacttcatggaacagggtccaggcacagaattccacactctgccctccagttaacaagccaaaacctcacgtacgctcccccatttgcaagtttaaagtttactcgtcctaaatgcagacttcatacctatcttccaaaagttgataaaagcaacgtggcaggtattttcgattttcccattccagatactgcctctatcagtcgacccttaccatttgtaacataatagattgaaacaacaggttaagtgctttggaattaagagttaaagggaaccgggggtggagaaaggaaaagaaggttgagacctccaaaacatagttttctgttctatgggaatttttgctctcattatctgggaagtgttcttaaaaataagaattaatagcaaagatgcagcaaagctctgaggatgcatttgcctgatatttttttctttgctcttgtgtttttgtatgtagttataaatactgtagattttttttttgtgattttttgccaaagttgttgttctatttatacattttaatgtcttaagacattttttcaatatcacaaaaagattttactgcgtattttgcaaagaaaaaaagctcactacctttagcttgcacatacttgcaaagttaattaaaaggctttttgttttaaaggggattttgtaaaatatccatataaataatgtatttatctttcgaatttgtacattgcttttcccttcttcctcttccttccacccccaatttattttattgtgtatgtttgctacgtgaaaagtgcgtatttgtttggtcacctacacttgtattagctgtttcaatgtgatttttaaacatttcatttatagttatttttagtattgttataaaccatgcttcagtttttttaatttccacccaaaagtcattgtctatttttgtattatttgtaagttaagaagttttttccaatatatggcaaaaaaaaaaaaatagtagcatattattcttgtagtatttagttcagtagatttaaaaaaaaatgtatcctttgctttggaagcttacaaaacaaccctaatgctgttttactctattaatatgcatggaatctctccctttggagtgacgcattttgtgcattaaattctagggagaaacttcatagaaatcaatgaacatactttctttcttaagtctgcttgtatatttcctctgtctttcacataaatataaaccagcagattggatgccttaacaatgcaaatcatattcatttcacttgtacattgtaactgtgcaccagaactgtcagtcatcactaacattctaagaaaaaagaaaaagaaaaaaagaaaaaaaaaaaaacaaagaaatcgaaaagcacaaaagaactgttttgttaccttaagacaatgtaactttttctagtagagcaagaaatcatttacaacaatgctgcaactgtgcatgcccccatatggattttgcaatggttttcactaggctgtcaagagtgcgatttttatgggttggggtgggtgggggaggggagttgtgggagggtaggggagggaggaaagctgtttttcatggtgagaaataataatgatgactaataataataaaaaaaactggaaaatgtaagcaaggtggacgcattgcttctcggtactcagaaaggttatctgaatttgcgtggtaagcgctggcctgaagatgtacacaagttaaagccatattttatctggtgagccccttaactgtttctgaaggaatgaacggtcagccgggaaggtgtccggcttagaccttgacaacagacactacccatctgtcagccatgtgcagtggttagaactcttcttgaaagtccaaagagcctttaaaatgtgtataatttgtgttttgttgcttctatttctattgattagatgaaaagacattctggccctctgatcctctttcttctccacaaaagttttacaaataaaagatgttcccctaaatacagaatatggctttaagaagaaaatgaaatgaagaattaaattaagatttcagtgttgggggaaaaaatacagcttctggatgactggattgcataacattgccctggcctcacattgtactaggatgcagcttaaatgaagtcatctctaaatctactaacctttcaccttcttatcaaaactttttgaatagacacacactgtacagttcaattgttagagaacctaactactgtagagattgttaaattttttttttttttttgcaaaaattcaagctgtaaaaacttttcaactttcacaatatttaattaaagttacttcctgtctgtga

SEQ ID NO: 128910 - DNA, 2345 bp, Homo sapiens
  Payload ID: 5213
  Gene Symbol: EBF1
  Gene Name: early B-cell factor 1
  Uniprot ID: Q9UH73
  ENST ID: ENST00000380654
  CDS Start-End: 216-1898
gggttatcgctcagttttgagcagaggtttacattttttaaaaatttgctttccagcccgccttgatcttctaagtgcgagttcatcgtctgagaaaaaaaaaaatctctggttggcgtttttgtttcttttcttttctttcttttctttcctttttttttttttttaatttttttcaagggggaggagattttccacaagaaaaggttgttttcatgtttgggattcaggaaagcatccaacggagtggaagcagcatgaaggaagagccgctgggcagcggcatgaacgcggtgcggacgtggatgcagggcgccggggtgctggacgccaacacggcggcgcagagcggggtgggtctggcccgggctcactttgagaagcagccgccttccaatctgcggaaatccaacttcttccacttcgtcctggccctctacgacagacagggccagcccgtggagatcgagaggacagcgtttgtggggttcgtggagaaggaaaaagaagccaacagcgaaaagaccaataacggaattcactaccggcttcagcttctctacagcaatgggataaggacggagcaggatttctacgtgcgcctcattgactccatgacaaaacaagccatagtgtatgaaggccaagacaagaacccagaaatgtgccgagtcttgctcacacatgagatcatgtgcaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaagctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaaa

SEQ ID NO: 128911 - DNA, 2277 bp, Homo sapiens
  Payload ID: 5213
  Gene Symbol: EBF1
  Gene Name: early B-cell factor 1
  ENST ID: ENST00000517373
  CDS Start-End: 284-1855
gccaagcatacatctctaattttattattttggtcttttcgttggattttccctttcttctttttttcgggttatcgctcagttttgagcagaggtttacattttttaaaaatttgctttccagcccgccttgatcttctaagtgcgagttcatcgtctgagaaaaaaaaaaatctctggttggcgtttttgtttcttttcttttctttcttttctttcctttttttttttttttaatttttttcaagggggaggagattttccacaagaaaaggttgttttcatgtttgggattcaggaaagcatccaacggagtggaagcagcatgaaggaagagccgctgggcagcggcatgaacgcggtgcggacgtggatgcagggcgccggggtgctggacgccaacacggcggcgcagagcggggtgggtctggcccgggctcactttgagaagcagccgccttccaatctgcggaaatccaacttcttccacttcgtcctggccctctacgacagacagggccagcccgtggagatcgagaggacagcgtttgtggggttcgtggagaaggaaaaagaagccaacagcgaaaagaccaataacggaattcactaccggcttcagcttctctacagcaatgggataaggacggagcaggatttctacgtgcgcctcattgactccatgacaaaacaagccatagtgtatgaaggccaagacaagaacccagaaatgtgccgagtcttgctcacacatgagatcatgtgcagccgctgttgtgacaagaaaagctgtggcaaccgaaatgagactccctcagatccagtgataattgacaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaagctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcaggtagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatattt

SEQ ID NO: 128912 - DNA, 4430 bp, Homo sapiens
  Payload ID: 5213
  Gene Symbol: EBF1
  Gene Name: early B-cell factor 1
  ENST ID: ENST00000622875
  CDS Start-End: 12-1235
tgtttcttcacaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaaggtacgccctcttatctggaacatgctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaaagaaaaaaaggaaaaaaaaaaaagcttgtatgggacagaataggaatgccagttagattttttagaaaaactaagggtcggcttttgcgccttaaagcatatcaaatggtagttagctcagacagtgcattttcaatatctaacttaacatgccaccccttagcagtgcaagcttatttatctcttttgtattgttgtcttaagcaactgtgtaaataaatgcagcctggaaagttaaaacgcgatgtaagtgatcacatttttccctctactcgaaaatccagtgcctctagacagattgttaaaactgcatatttaaatctgatctcattctctccttttacttaagtcagtttcttctgaagccgatggcctctcgagagcttggtggcacacatactgtgtgagaatctcctttgagacttcatggaacagggtccaggcacagaattccacactctgccctccagttaacaagccaaaacctcacgtacgctcccccatttgcaagtttaaagtttactcgtcctaaatgcagacttcatacctatcttccaaaagttgataaaagcaacgtggcaggtattttcgattttcccattccagatactgcctctatcagtcgacccttaccatttgtaacataatagattgaaacaacaggttaagtgctttggaattaagagttaaagggaaccgggggtggagaaaggaaaagaaggttgagacctccaaaacatagttttctgttctatgggaatttttgctctcattatctgggaagtgttcttaaaaataagaattaatagcaaagatgcagcaaagctctgaggatgcatttgcctgatatttttttctttgctcttgtgtttttgtatgtagttataaatactgtagattttttttttgtgattttttgccaaagttgttgttctatttatacattttaatgtcttaagacattttttcaatatcacaaaaagattttactgcgtattttgcaaagaaaaaaagctcactacctttagcttgcacatacttgcaaagttaattaaaaggctttttgttttaaaggggattttgtaaaatatccatataaataatgtatttatctttcgaatttgtacattgcttttcccttcttcctcttccttccacccccaatttattttattgtgtatgtttgctacgtgaaaagtgcgtatttgtttggtcacctacacttgtattagctgtttcaatgtgatttttaaacatttcatttatagttatttttagtattgttataaaccatgcttcagtttttttaatttccacccaaaagtcattgtctatttttgtattatttgtaagttaagaagttttttccaatatatggcaaaaaaaaaaaaatagtagcatattattcttgtagtatttagttcagtagatttaaaaaaaaatgtatcctttgctttggaagcttacaaaacaaccctaatgctgttttactctattaatatgcatggaatctctccctttggagtgacgcattttgtgcattaaattctagggagaaacttcatagaaatcaatgaacatactttctttcttaagtctgcttgtatatttcctctgtctttcacataaatataaaccagcagattggatgccttaacaatgcaaatcatattcatttcacttgtacattgtaactgtgcaccagaactgtcagtcatcactaacattctaagaaaaaagaaaaagaaaaaaagaaaaaaaaaaaaacaaagaaatcgaaaagcacaaaagaactgttttgttaccttaagacaatgtaactttttctagtagagcaagaaatcatttacaacaatgctgcaactgtgcatgcccccatatggattttgcaatggttttcactaggctgtcaagagtgcgatttttatgggttggggtgggtgggggaggggagttgtgggagggtaggggagggaggaaagctgtttttcatggtgagaaataataatgatgactaataataataaaaaaaactggaaaatgtaagcaaggtggacgcattgcttctcggtactcagaaaggttatctgaatttgcgtggtaagcgctggcctgaagatgtacacaagttaaagccatattttatctggtgagccccttaactgtttctgaaggaatgaacggtcagccgggaaggtgtccggcttagaccttgacaacagacactacccatctgtcagccatgtgcagtggttagaactcttcttgaaagtccaaagagcctttaaaatgtgtataatttgtgttttgttgcttctatttctattgattagatgaaaagacattctggccctctgatcctctttcttctccacaaaagttttacaaataaaagatgttcccctaaatacagaatatggctttaagaagaaaatgaaatgaagaattaaattaagatttcagtgttgggggaaaaaatacagcttctggatgactggattgcataacattgccctggcctcacattgtactaggatgcagcttaaatgaagtcatctctaaatctactaacctttcaccttcttatcaaaactttttgaatagacacacactgtacagttcaattgttagagaacctaactactgtagagattgttaaattttttttttttttttgcaaaaattcaagctgtaaaaacttttcaactttcacaatatttaattaaagttacttcctgtctgtgatggc

SEQ ID NO: 128913 - DNA, 1888 bp, Homo sapiens
  Payload ID: 5214
  Gene Symbol: EBF2
  Gene Name: early B-cell factor 2
  ENST ID: ENST00000408929
  CDS Start-End: 358-1641
gcacttcccaaagtccctcctgaacctggaactcagtccctgagctcgtggccctgcgtgcgcagtcctcgcgggataggcccgaatgctgcctttccaaatgacaagtcccttcacttttctgccaagggaagccttggggcttcctaaggacagacagagcccgatgggttgggtggtgcctgtttaaaggcagctttggaacaaggcaacgagaagaccaacaacggcactcactacaagttacagctcctctacagcaacggtgtccgcacggaacaggacctctatgtcaggctcatcgactcggtcaccaagcagcccatcgcttacgagggacagaataagaatccggaaatgtgccgagttctcctgacgcacgaagtgatgtgtagtcgatgctgcgaaaagaaaagctgtggaaaccgaaatgagactccatcggacccagtcataattgacagattctttttaaaatttttcctcaagtgcaatcagaattgtttgaaaacagcaggaaacccaagggacatgagacggtttcaggttgtgttgtcaacaacggtgaatgtggatggacacgtcctggctgtttctgacaacatgtttgttcataacaactccaagcatggacggagagcaagaagactcgatccatcggaagctaccccctgcatcaaagccattagcccgagtgaaggctggaccacaggaggagccatggtcatcatcatcggggacaacttctttgatggtctccaagtggtgtttgggactatgcttgtatggagcgagctaataacccctcatgccatcagagtacagactcctccccggcacatcccaggcgtggtagaggtgacattatcttataaatctaaacagttctgcaaaggagccccaggaaggttcatttacacagcattaaatgaacccaccatagactatggcttccagagactgcagaaggtcatccctaggcatcctggagatcctgagagattagctaaggagatgctgttgaaaagagctgcagatctagtggaagctctttatggcacaccacacaataaccaggacatcattttgaagcgagccgcagacattgctgaagctctctacagcgtccccaggaatcccagccagcttccagccctctctagctccccagcgcacagtggcatgatgggaatcaactcctatggcagccagcttggggtcagcatctcagagtcaacacaaggaaataatcaagggtacatccgcaacacaagcagcatctctccgcggggatactcttccagctccacgcctcaacagtctaattacagtacctccagcaacagtatgaatggctacagcaatgtccccatggccaacttgggtgttccaggttcaccaggatttctaaatggctcacccaccggctctccttatggaatcatgtcatcaagtcccaccgttgggtcttccagcacatcctccatcctcccattttcctcttcagtttttcctgctgtcaaacagaagagtgcctttgcccctgtcatcaggccccaaggctccccttcacctgcctgctccagcggcaatggaaatggattcagagccatgaccggacttgttgtacccccgatgtaaagaagaactgctttcttatagcacaaaactacttactctgatggaccaataatgaagaaagcactaggagctcttttgggggtgtagtggtgcccccacatgaacatgatggacacccttgggtctgcaaggagccagcatcttacttggtcccacgtcctcctatagctctgatggtggctacacaaactgaccctcttgggacaaggacaaaagatgtcattgacgtagtcagtgctaagagcag

SEQ ID NO: 128914 - DNA, 5145 bp, Homo sapiens
  Payload ID: 5214
  Gene Symbol: EBF2
  Gene Name: early B-cell factor 2
  Uniprot ID: Q9HAK2
  ENST ID: ENST00000520164
  CDS Start-End: 539-2266
attcatggggcccgcgcgcggctgcagccgggctccgtggcgctcgcagccaccgcctcctctcggctccaggtcttccccttctttttacaactgatcctgttggggattttttttttttctaaattggaacggtggggaggagcagggaggggggacctggaggaaggggagagattaggcagccatcaatttcctccagtttctcccagaacaggtgatgcttctaaattgtgatcactttcaggaggcagcactgcagctggaaggatgcgagcgacctagggtggagtggctgaggcggcagatctgaacttgcggaggataagaacccaaactttgactacatcagtccgcacctcgccagtgaagcaaaggacgggttatcttttttttttttctaagactcaaacttgggcacttgatcccttttcttggattgctttggaggagacgatttgctggcaacgttgggaacagtcaggactgtgttgtaactcttacttttaaagcgacagtagaggatcagactttttaaatgtttggaattcaagatactttaggaagaggaccaactctgaaagagaaatcgctgggcgcggagatggattcggtcaggtcctgggtccggaatgtcggagtggtggacgctaatgtcgccgcgcagagcggggtcgccctgtcccgggcccactttgagaaacagcctccttccaacttgaggaaatccaacttctttcacttcgtcctggcgctctatgacaggcagggccagccggtggagatcgagcggacggccttcgtggactttgtggagaatgacaaagaacaaggcaacgagaagaccaacaacggcactcactacaagttacagctcctctacagcaacggtgtccgcacggaacaggacctctatgtcaggctcatcgactcggtcaccaagcagcccatcgcttacgagggacagaataagaatccggaaatgtgccgagttctcctgacgcacgaagtgatgtgtagtcgatgctgcgaaaagaaaagctgtggaaaccgaaatgagactccatcggacccagtcataattgacagattctttttaaaatttttcctcaagtgcaatcagaattgtttgaaaacagcaggaaacccaagggacatgagacggtttcaggttgtgttgtcaacaacggtgaatgtggatggacacgtcctggctgtttctgacaacatgtttgttcataacaactccaagcatggacggagagcaagaagactcgatccatcggaagctaccccctgcatcaaagccattagcccgagtgaaggctggaccacaggaggagccatggtcatcatcatcggggacaacttctttgatggtctccaagtggtgtttgggactatgcttgtatggagcgagctaataacccctcatgccatcagagtacagactcctccccggcacatcccaggcgtggtagaggtgacattatcttataaatctaaacagttctgcaaaggagccccaggaaggttcatttacacagcattaaatgaacccaccatagactatggcttccagagactgcagaaggtcatccctaggcatcctggagatcctgagagattagctaaggagatgctgttgaaaagagctgcagatctagtggaagctctttatggcacaccacacaataaccaggacatcattttgaagcgagccgcagacattgctgaagctctctacagcgtccccaggaatcccagccagcttccagccctctctagctccccagcgcacagtggcatgatgggaatcaactcctatggcagccagcttggggtcagcatctcagagtcaacacaaggaaataatcaagggtacatccgcaacacaagcagcatctctccgcggggatactcttccagctccacgcctcaacagtctaattacagtacctccagcaacagtatgaatggctacagcaatgtccccatggccaacttgggtgttccaggttcaccaggatttctaaatggctcacccaccggctctccttatggaatcatgtcatcaagtcccaccgttgggtcttccagcacatcctccatcctcccattttcctcttcagtttttcctgctgtcaaacagaagagtgcctttgcccctgtcatcaggccccaaggctccccttcacctgcctgctccagcggcaatggaaatggattcagagccatgaccggacttgttgtacccccgatgtaaagaagaactgctttcttatagcacaaaactacttactctgatggaccaataatgaagaaagcactaggagctcttttgggggtgtagtggtgcccccacatgaacatgatggacacccttgggtctgcaaggagccagcatcttacttggtcccacgtcctcctatagctctgatggtggctacacaaactgaccctcttgggacaaggacaaaagatgtcattgacgtagtcagtgctaagagcagaaatgcaattctttgttatgaacattatgaaaaccaccttcctatgtttgtaaaatatttaagaaaaaattggcaaacaattaatgcttaatattttggatactatttgtttttctttgtaggaaaaaaaagttgaaagtttctattttctatgaagcctttcagataccaatttagtttatgcagaaaaaaattgaacaaaacagggtaccagcacggaagactttcttaaaacgcaacctgaattgaatgatgaaatgttgtatgtgtgtttgcttatagcttaatctctttaaaaaatgaacaaaaaaagggaaaaattttaaaatgttttacaattatttaaataaataaatgtgtaacttattgtaagtagaggtagaaattaagacctttttttggaagagagagggatttctcttcctgatgtaaaatgaaaatgatgcaaacatgtagtaacaagttttaaaggtgtgtgattattactgcagttacttactagattcttatcccctgtcctgcaccccctccttttccatcactttattgacccaagggcaagaacatgtagattcccacagaacaccctaatgcagaaacagacactctagcacatgcacaaatactccaacccatcaattcattcccagctccgtctgatttctaaatagtccacactcttgtgaatactttttaaaattcctattattagctttcaacgttctcccctgagcagtccagagaattcccatgtttgagtctgtctcaggctttcagcatcccaaggaaagaagcacctcaccttctagcagagccaaaaccacagactttcttaaccaagggaccccttgggaattcctcctcaccagaaccccaccactccctccgctttgggtgcctggttcagtacagaggtacacagccccatagaacttcagcaacacggtttggagaagataactctgtttgatggactctttagagtcagtcttagaacatccaagtcctttcctctccctgtcaatttccccttttatggcattaaactctcttgaaaaacatagctatgccactcgacagtttctagtcaagaatgagacggaatgtgggagagggatattaaaagccctaatcccctcttctgatgttcgaagaaaggcaagaccagattcttgggagatccagagattaggggcatctgcgttctatgcagcacagttacccagccctttgatgggctcttcatcgttttgtgactagctcttagaggggaagaaccttgccttagctgctaacagtggttgattcttgaaagcttatgtaatcctagagacatatccaggcatattgggattgccaataaagatgtcacttgtttccacgttggggttctccttattgactcatgagcaccacaatagagtctatacacagacttagtttggggttcttggttgggatttcagcattagaaatagatgcagcactcatggaaaaacatcatgagtgcatctgagccaattttagatgatttcattaattctgcataccttctctttgacccattgatgcaggcccacatctatccagccccaactgtcttatttgcctttaacccattctggaattacccagtatgacttatattatttctatgcacatgagaatccaaggttttagaaacctggcatgcttataactactgctgacagtccctcatagtcagggcttaaagcgccaaaatacacggaaacataagagaaaaagtcccccagtgagaaacctgattgatggaaggggaagaatgtgtggaatatgaatgttaccttccaaaagtgaaggcagagcaaaattaagcatgtttagccctggatttgagccaatccaacataaggaaattttgttttttttaagtagcattgcttttagaacctgtgaattttccttttgcatgaagatgagtgcagtactgtcttcaaaatgattgtagaatttcttggtagctttacaccgaaaaatgcgtgtaactaaataccagacatcttgaccattcagctagaaccctggcagcaacagagctatttaattgtacaaatgtgtgtaaggattatttttagtgtactaataaattaaaaacaaagctaccctgtcctcgttagtcattgctattcaatcattccagtcccaagttatttttgtgccacttggaatatgagtatttctattggtaactacaaactctatcctgtgtttgtaagaggagctgtgtaagatttttttcatttaaagggacaatttacttcattatttatctttcttttgttatagcgttgtaattcttctcagtttttctttgcacatttcaatatgcatggtttaaaaaccattaacttctctaccttttgtacagtaaggtttcattttcacactgtatagtttcattttattgttttgctttgtcagttatatacagtataaagttgctatgcacagagctttttgtaaagacagcttttttgtttactgtttttaatggtcttacttaaagaatatcttgtttgtaaaatgaatatgtctacttcagttttaaactttaaattatcctaacaaaaaaataaaatttttgtactgt

SEQ ID NO: 128915 - DNA, 1017 bp, Homo sapiens
  Payload ID: 5214
  Gene Symbol: EBF2
  Gene Name: early B-cell factor 2
  Uniprot ID: Q9HAK2
  ENST ID: ENST00000535548
  CDS Start-End: 1-795
atggtcatcatcatcggggacaacttctttgatggtctccaagtggtgtttgggactatgcttgtatggagcgagctaataacccctcatgccatcagagtacagactcctccccggcacatcccaggcgtggtagaggtgacattatcttataaatctaaacagttctgcaaaggagccccaggaaggttcatttacacagcattaaatgaacccaccatagactatggcttccagagactgcagaaggtcatccctaggcatcctggagatcctgagagattagctaaggagatgctgttgaaaagagctgcagatctagtggaagctctttatggcacaccacacaataaccaggacatcattttgaagcgagccgcagacattgctgaagctctctacagcgtccccaggaatcccagccagcttccagccctctctagctccccagcgcacagtggcatgatgggaatcaactcctatggcagccagcttggggtcagcatctcagagtcaacacaaggaaataatcaagggtacatccgcaacacaagcagcatctctccgcggggatactcttccagctccacgcctcaacagtctaattacagtacctccagcaacagtatgaatggctacagcaatgtccccatggccaacttgggtgttccaggttcaccaggatttctaaatggctcacccaccggctctccttatggaactggactttggctcacgtggttactcaaggccttttggggaaagaaaaggattgaaacaattccgtttttatagagaaagagcatgtgtggcctgttcatgtcatcaagtcccaccgttgggtcttccagcacatcctccatcctcccattttcctcttcagtttttcctgctgtcaaacagaagagtgcctttgcccctgtcatcaggccccaaggctccccttcacctgcctgctccagcggcaatggaaatggattcagagccatgaccggacttgttgtacccccgatgtaa

SEQ ID NO: 128916 - DNA, 2993 bp, Homo sapiens
  Payload ID: 5215
  Gene Symbol: EBF3
  Gene Name: early B-cell factor 3
  Uniprot ID: Q9H4W6
  ENST ID: ENST00000355311
  CDS Start-End: 74-1864
ccgccaagccccgagcgccgctgctcgaggaaacgctttcggccgggagctgcggccgccgccagcagttttcatgtttgggattcaggagaatattccgcgcggggggacgaccatgaaggaggagccgctgggcagcggcatgaacccggtgcgctcgtggatgcacacggcgggcgtggtggacgccaacacggccgcccagagcggcgtggggctggcgcgggcgcacttcgagaagcagccgccttccaacctccggaaatccaatttcttccacttcgtgctggcgctctacgataggcaggggcagccggtggagattgaaaggaccgcttttgtggactttgtggagaaagagaaagagccaaacaacgagaaaaccaacaacggcatccactataaactccagttattgtacagcaacggagtcagaacagagcaagatctgtatgttcgcctcatagattcaatgaccaaacaggccatcgtctacgagggccaggacaagaacccggagatgtgccgtgtgctgctgacccacgagatcatgtgcagccggtgctgtgacaagaaaagttgtggcaatagaaacgaaacgccctcagaccctgtaatcattgacagattctttctaaagtttttcctcaagtgcaatcagaactgtttgaagaatgcaggcaaccctcgagatatgcggagattccaggttgttgtatcgacaacagtcaacgtggacggccacgtgctggccgtgtcagacaacatgtttgtgcacaacaattccaaacacgggaggcgggcccgccgcctagacccgtcagaaggtacggccccttcttatctggaaaatgccactccgtgcatcaaggccatcagtcccagtgaaggctggaccacggggggtgccaccgtcatcataattggcgacaacttctttgacgggctgcaagttgtattcggaactatgttggtgtggagcgagctgataactccccatgccatccgagtccagaccccgccgaggcacattcctggcgtcgtcgaagtgaccctctcctacaaatccaagcagttctgcaaaggtgctcctgggcgctttgtctacaccgcccttaatgaaccaaccatagattacggctttcagaggttgcagaaagtgatcccaagacatccgggtgatcccgaaaggttacccaaggaggtgttactgaagcgggcggcggacctggtggaagccttatacggaatgcctcacaacaaccaggagatcatcttgaagcgagcggcggacatcgccgaggcgctgtacagcgttccccgcaatcacaaccagatccccaccctgggcaacaaccctgcacacacgggcatgatgggcgtcaactccttcagcagccagctagccgtcaacgtgtcagagacgtcacaagccaacgaccaagtcggctacagtcgcaatacaagcagcgtgtccccgcgaggctacgtccccagcagtactccccagcagtccaattacaacacagtcagcactagcatgaatggatatggaagtggcgccatggccagtctaggggtccctggctcgcctggatttcttaatggctcctccgctaactctccctacggcatagtgccgtccagccccaccatggcagcctcttcggtcaccctcccttcaaactgtagcagcacacacggcattttctcattctcacctgccaatgtcatctccgcagtgaaacagaagagcgccttcgcgcccgtggtccggccccaagcctctcctcctccttcctgcaccagcgccaacgggaatggactgcaagctatgtctgggctggtagtcccgccaatgtgagggacttctgtttaccttccgcagcacccagcatcaaaggacggacttcaggggacacgtttagtatattaagacatgctgatggaaacagtatcttcaaaaaaatcagcagcaattgaaatgctacaaaagactttgtttaaagattttatttaaactattaagaatcaacatgcaaacagcctacttcttcatgaacaattccattttattgactgaacttttctcatattttcacatttctcagtcctgaagaataaggaaaacaaagcgacgcctattttgtataaagtttccgactccgtcttggccatgtctagtaattgctatgtgttgggagaaactttgtgaatgcaccattttgatgatcatgaaacgctgatgaaaaatgcctccaaacatttttctgtactcatacttagattcacaatggttgtgtatctctataatgtgaaatatttttttgtggtgataaaaagagggccaaggaggtatgagccatcagactggaaaaaaggatgactatatgatgaggagaaactggggtggcagggagggagggagggtttatcactgcttaacttcatcttcatgaaatgaaactttgtaacttattgtagttagaaattgtaactttgatattgaattctcttgccttcaacaagcacactgacagagaaaaaatgctactgtctgttggttccaatattctcccactgctagagcttcctgttaagcaagtgtgatctgcaacattttttcaacttttgctagcactgtatactattgcattcttaggctactgtgaggtctatgtttcttgtaccagaaattgtccttttgacttctagatccttcttccctaatgtgttttgtatgtggttataaaattgtagacttttgtgattttgccaaagttgtagctaaatatttatacacttgtcttgaatttttttcagatccacttaaaatatttagaaaaacaagttttattccttatgtgtcttataaggaataaaatggtcttcatttgacacttactttcccatgaacacttgcagttgctaagggactttattttgtaacatatcaattataaatattgtatttatctttgaaattttgtaca

SEQ ID NO: 128917 - DNA, 4375 bp, Homo sapiens
  Payload ID: 5215
  Gene Symbol: EBF3
  Gene Name: early B-cell factor 3
  Uniprot ID: Q9H4W6
  ENST ID: ENST00000368648
  CDS Start-End: 74-1729
ccgccaagccccgagcgccgctgctcgaggaaacgctttcggccgggagctgcggccgccgccagcagttttcatgtttgggattcaggagaatattccgcgcggggggacgaccatgaaggaggagccgctgggcagcggcatgaacccggtgcgctcgtggatgcacacggcgggcgtggtggacgccaacacggccgcccagagcggcgtggggctggcgcgggcgcacttcgagaagcagccgccttccaacctccggaaatccaatttcttccacttcgtgctggcgctctacgataggcaggggcagccggtggagattgaaaggaccgcttttgtggactttgtggagaaagagaaagagccaaacaacgagaaaaccaacaacggcatccactataaactccagttattgtacagcaacggagtcagaacagagcaagatctgtatgttcgcctcatagattcaatgaccaaacaggccatcgtctacgagggccaggacaagaacccggagatgtgccgtgtgctgctgacccacgagatcatgtgcagccggtgctgtgacaagaaaagttgtggcaatagaaacgaaacgccctcagaccctgtaatcattgacagattctttctaaagtttttcctcaagtgcaatcagaactgtttgaagaatgcaggcaaccctcgagatatgcggagattccaggttgttgtatcgacaacagtcaacgtggacggccacgtgctggccgtgtcagacaacatgtttgtgcacaacaattccaaacacgggaggcgggcccgccgcctagacccgtcagaagccactccgtgcatcaaggccatcagtcccagtgaaggctggaccacggggggtgccaccgtcatcataattggcgacaacttctttgacgggctgcaagttgtattcggaactatgttggtgtggagcgagctgataactccccatgccatccgagtccagaccccgccgaggcacattcctggcgtcgtcgaagtgaccctctcctacaaatccaagcagttctgcaaaggtgctcctgggcgctttgtctacaccgcccttaatgaaccaaccatagattacggctttcagaggttgcagaaagtgatcccaagacatccgggtgatcccgaaaggttacccaaggaggtgttactgaagcgggcggcggacctggtggaagccttatacggaatgcctcacaacaaccaggagatcatcttgaagcgagcggcggacatcgccgaggcgctgtacagcgttccccgcaatcacaaccagatccccaccctgggcaacaaccctgcacacacgggcatgatgggcgtcaactccttcagcagccagctagccgtcaacgtgtcagagacgtcacaagccaacgaccaagtcggctacagtcgcaatacaagcagcgtgtccccgcgaggctacgtccccagcagtactccccagcagtccaattacaacacagtcagcactagcatgaatggatatggaagtggcgccatggccagtctaggggtccctggctcgcctggatttcttaatggctcctccgctaactctccctacggcatgaaacagaagagcgccttcgcgcccgtggtccggccccaagcctctcctcctccttcctgcaccagcgccaacgggaatggactgcaagctatgtctgggctggtagtcccgccaatgtgagggacttctgtttaccttccgcagcacccagcatcaaaggacggacttcaggggacacgtttagtatattaagacatgctgatggaaacagtatcttcaaaaaaatcagcagcaattgaaatgctacaaaagactttgtttaaagattttatttaaactattaagaatcaacatgcaaacagcctacttcttcatgaacaattccattttattgactgaacttttctcatattttcacatttctcagtcctgaagaataaggaaaacaaagcgacgcctattttgtataaagtttccgactccgtcttggccatgtctagtaattgctatgtgttgggagaaactttgtgaatgcaccattttgatgatcatgaaacgctgatgaaaaatgcctccaaacatttttctgtactcatacttagattcacaatggttgtgtatctctataatgtgaaatatttttttgtggtgataaaaagagggccaaggaggtatgagccatcagactggaaaaaaggatgactatatgatgaggagaaactggggtggcagggagggagggagggtttatcactgcttaacttcatcttcatgaaatgaaactttgtaacttattgtagttagaaattgtaactttgatattgaattctcttgccttcaacaagcacactgacagagaaaaaatgctactgtctgttggttccaatattctcccactgctagagcttcctgttaagcaagtgtgatctgcaacattttttcaacttttgctagcactgtatactattgcattcttaggctactgtgaggtctatgtttcttgtaccagaaattgtccttttgacttctagatccttcttccctaatgtgttttgtatgtggttataaaattgtagacttttgtgattttgccaaagttgtagctaaatatttatacacttgtcttgaatttttttcagatccacttaaaatatttagaaaaacaagttttattccttatgtgtcttataaggaataaaatggtcttcatttgacacttactttcccatgaacacttgcagttgctaagggactttattttgtaacatatcaattataaatattgtatttatctttgaaattttgtacattgcttttcccaccttttcctttttcttctttcttgtctgtattggtttttgatcacggcctggtgttgtgatactgggaagagcattagccaagaacttgtctctttgatctgtttcgttaagctgaaccagtgtctttacatttcatttgtacttcaaaaaatatgctattgtttagactttccatcctttttttttttattttgaggaaaagtcaaattcattgtttatttttatattatttttaagttatctgaacaaatacttttgaaaaaaaagtttgttgtatagtcaaaacaaatcggtgccacccggccgtgacaaatcctagtagattctgtgcatgtggagcggccgcgaagaggtgacaccgtttggggctgtgtccttattttattttatttttttgtagaatgtaaaaagtcattttagatgccacccattgactttgccacatagctgaactgtgtttactggaaaaattcagaggcctaaagtttaaaataaaatttacttctgatgttttaattaaaatgtttgccacattaacttttctgatgccttaaaagtgaacttctttaaagaacctttgtgctattttatcacaggcttacactacaattgttaataaatacttcatttggagatgtatggtgtaaaacacacaaacacacacaaaaaagcacaagcccgctgcatgacccgtctctcctttctgggactatttctgctgcgtcctgcaccctcctgggcccacctccgattcacagaggtttcagggggacccaaatcactgctggttttcaatttttttttaacaatacatttttgtggtcagttccaacagcactgtccgtacttttaaaactggaatgacctccttcagatatcgtgcctcttagtgccaaacccacagtgagaccaaaagtgtcaggtgtttttttttttttctttctcctttgcactaagtgctttgcagacacggcacagcaaacattttgcaaactgcagcagaaatcgaatttaaaacaaaaaggagggactttaaaataccttcttgacaaaaatcaacaatgcacaacttacaaagtgttcattctagggacaaaattaaataaacagaatgtccccaggagtcagcaggtcacagtctggctttgtgatggttgacaaggtctagctacatgggaaagcctgagaagtcactttggaactaaattgcctccattttattttgtacgagtaagggtttgatctacaaaagagctcacatggacgcactgagaacgcctgccagcttccccatgccctcacttggtttgtgttttaggttaagtagtcaatgcccacatcacttcactgtctcaagactgagcacttcactaaatggtagattttactgttaaagaccctacaataagattgttttatctgtacattttttcagatatttaactgtataaaaatgttcattttacacaatatttaattaaagtatttcttgtctgtgaatttc

SEQ ID NO: 128918 - DNA, 817 bp, Homo sapiens
  Payload ID: 5215
  Gene Symbol: EBF3
  Gene Name: early B-cell factor 3
  ENST ID: ENST00000440978
  CDS Start-End: 1-574
cttcagcagccagctagccgtcaacgtgtcagagacgtcacaagccaacgaccaagtcggctacagtcgcaatacaagcagcgtgtccccgcgaggctacgtccccagcagtactccccagcagtccaattacaacacagtcagcactagcatgaatggatatggaagtggcgccatggccagtctaggggtccctggctcgcctggatttcttaatggctcctccgctaactctccctacggcatagtgccgtccagccccaccatggcagcctcttcggtcaccctcccttcaaactgtagcagcacacacggcattttctcattctcacctgccaatgtcatctccgcagtgaaacagaagagcgccttcgcgcccgtggtccggccccaagcctctcctcctccttcctgcaccagcgccaacgggaatggactgcaaggctctctgctgggtgctgaggacgtagccgcggagaagacaaactggcccttttgtgaagtcggtggcatatttcactttgatgaactaatgctcaaaaaaggaactggaaagctatgtctgggctggtagtcccgccaatgtgagggacttctgtttaccttccgcagcacccagcatcaaaggacggacttcaggggacacgtttagtatattaagacatgctgatggaaacagtatcttcaaaaaaatcagcagcaattgaaatgctacaaaagactttgtttaaagattttatttaaactattaagaatcaacatgcaaacagcctacttcttcatgaacaattccattttattgactgaacttttctca

SEQ ID NO: 128919 - DNA, 2705 bp, Homo sapiens
  Payload ID: 5216
  Gene Symbol: EBF4
  Gene Name: early B-cell factor 4
  ENST ID: ENST00000342725
  CDS Start-End: 1-1866
cggccgcggcggggcggcgcgggaaccgggccccggggggagtcggccgggctgctgctgctgctgctccaggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccatcatgccctctagccccccgctggcggctgcctcctccatgtccctcccggccgctgcccccaccaccagcgtgttctccttctcgcctgtcaacatgatctccgccgtcaaacagaggagcgccttcgcccccgtgctgcgccccccaagctccccaccccaggcctgccccagagcccacggagaggggcttccagaccagtcttttgaggattctgacaagtttcactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctcctt

SEQ ID NO: 128920 - DNA, 2910 bp, Homo sapiens
  Payload ID: 5216
  Gene Symbol: EBF4
  Gene Name: early B-cell factor 4
  ENST ID: ENST00000380648
  CDS Start-End: 269-2065
gcggccgcggcggggcggcgcgggaaccgggccccggggggagtcggccgggctgctgctgctgctgctccaggtgctgccgcccggggctacggcagggccgggacgccggggcacgcggggcgctggcgctggcggcggcggcgtctgctggcccggcgcggccccagcctttccccgggacgcgcggctgctgctgctcctgccgccgctgccgccactgtcgccgccgccgccgagctccgcgcccgcagcctccgcctcccggatggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccatcatgccctctagccccccgctggcggctgcctcctccatgtccctcccggccgctgcccccaccaccagcgtgttctccttctcgcctgtcaacatgatctccgccgtcaaacagaggagcgccttcgcccccgtgctgcgccccccaagctccccaccccaggcctgccccagagcccacggagaggggcttccagaccagtcttttgaggattctgacaagtttcactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctccttggtgtg

SEQ ID NO: 128921 - DNA, 2788 bp, Homo sapiens
  Payload ID: 5216
  Gene Symbol: EBF4
  Gene Name: early B-cell factor 4
  ENST ID: ENST00000449079
  CDS Start-End: 269-1891
gcggccgcggcggggcggcgcgggaaccgggccccggggggagtcggccgggctgctgctgctgctgctccaggtgctgccgcccggggctacggcagggccgggacgccggggcacgcggggcgctggcgctggcggcggcggcgtctgctggcccggcgcggccccagcctttccccgggacgcgcggctgctgctgctcctgccgccgctgccgccactgtcgccgccgccgccgagctccgcgcccgcagcctccgcctcccggatggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccaaggagcgccttcgcccccgtgctgcgccccccaagctccccaccccaggcctgccccagagcccacggagaggggcttccagaccagtcttttgaggattctgacaagtttcactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctcctt

SEQ ID NO: 128922 - DNA, 2012 bp, Homo sapiens
  Payload ID: 5216
  Gene Symbol: EBF4
  Gene Name: early B-cell factor 4
  Uniprot ID: Q9BQW3
  ENST ID: ENST00000609451
  CDS Start-End: 73-1881
tgagctagacgcccgcagcctcagcgggaccggatccggggcggcgggggcgctcactcaccgcgcgccctcatgttccctgcgcaggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccatcatgccctctagccccccgctggcggctgcctcctccatgtccctcccggccgctgcccccaccaccagcgtgttctccttctcgcctgtcaacatgatctccgccgtcaaacagaggagcgccttcgcccccgtgctgcgccccccaagctccccaccccaggcctgccccagagcccacggagaggggcttccagaccagtcttttgaggattctgacaagtttcactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacg

SEQ ID NO: 128923 - DNA, 642 bp, Homo sapiens
  Payload ID: 5216
  Gene Symbol: EBF4
  Gene Name: early B-cell factor 4
  ENST ID: ENST00000463145
  CDS Start-End: 1-534
ctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgccc

SEQ ID NO: 128924 - DNA, 9875 bp, Homo sapiens
  Payload ID: 5217
  Gene Symbol: EEA1
  Gene Name: early endosome antigen 1
  Uniprot ID: Q15075
  ENST ID: ENST00000322349
  CDS Start-End: 266-4501
atctgtcagttacgggggctgcccggcgggcgggctggaggcgctcgcaggctgcctagtcgttcgctcgctctctctcgcgtgctccctctcgccgcctgtggggaagtcggggccgcccgagcggccgtcgccaccgcctcgccccgacctccttcccggtcccctcccggcccagtccctcccgcccgcgcaccccgagtagtgagtggccccgcgcagggtctggagagtcaccgcggcggcgccgggtggtggttaaaccatgttaaggaggattttacagaggactcctgggagagttggctctcaaggttctgatttagattcatcagcaactcctataaacacagtggacgtcaataatgaaagctcttcagagggtttcatatgtccccagtgtatgaaatctcttggatctgctgatgaacttttcaaacattatgaagctgttcatgatgctggtaatgactcaggtcatggaggagagtctaatcttgctttgaagcgagatgatgtaacactgctcagacaagaggtccaagacctacaggcttcacttaaggaagaaaaatggtactcggaagaattaaagaaggaattagaaaaatatcaagggctgcagcagcaagaggccaaacctgatgggttggtgactgattcatcagcagaactacagtctttggaacagcaattagaagaagcccaaacagaaaattttaatattaagcaaatgaaagacttatttgaacagaaagcagcccaacttgctactgaaattgcagatataaagtcaaagtatgatgaagaaaggagtcttcgagaagctgctgaacaaaaagtgacacgtctgacagaagaattaaacaaagaggcaactgtaattcaagatctgaagacggaactgcttcagagacctggtatagaagatgttgccgtgctaaagaaagaactggtccaagttcaaacactaatggataacatgaccttggaacgtgagcgagaatctgaaaaactcaaagatgaatgcaaaaaattgcagtcacaatatgctagctcagaggccacaataagccagctaaggagtgaacttgccaaaggcccccaggaagttgctgtatatgtacaggaactacaaaaactgaaaagttcagttaatgaattaacacaaaaaaatcagaccttgacagaaaacttgctgaaaaaagaacaagactatactaagttagaggagaaacataatgaagaatctgtgagtaaaaagaatattcaggcaacccttcatcaaaaagacctagattgtcaacagcttcagtcaagattgtctgcatctgaaacctcactgcatagaatacatgtagaactaagtgaaaaaggagaagctactcaaaagctcaaagaagaattatctgaggtagagaccaagtaccagcatctaaaggcggagtttaagcagctacaacaacagagagaagaaaaggagcagcatgggttacaactccaaagtgaaattaatcaattacatagcaaacttctggagacagagcgccaactaggggaagctcatggtaggctgaaggaacagagacagctttcaagtgaaaagttgatggataaagaacaacaagtggctgatttacaactcaaactttctcggttagaagagcagttgaaggaaaaagttacaaattctacagaattgcagcatcaattagataaaacaaagcaacagcatcaagaacaacaggctcttcagcaaagcaccacggcaaaacttcgagaagctcagaatgatttggaacaagttctacgtcaaattggcgataaggaccaaaagatccagaaccttgaagctttattacagaagagtaaagaaaatatttcattactagaaaaagaaagagaagatctttatgcaaaaattcaggctggtgaaggagagactgctgttcttaaccagttacaagaaaaaaaccatacactacaggagcaagtaactcaactaacagagaagctgaagaatcagtcagaaagtcataaacaagcccaggagaatttgcatgaccaggtacaagagcagaaggcacatcttagagctgcacaagaccgtgtcctttccctagaaactagtgtcaatgaattaaatagtcaattaaatgaaagcaaggagaaggtctcccagcttgacatacagattaaagccaaaaccgaactattactatcagcagaagcagcaaaaactgctcaaagagctgatcttcagaatcatttggacacagctcaaaatgcattacaagataaacagcaggagttaaataagattactactcagttggatcaggtcactgcaaagttacaagacaagcaagaacattgcagtcagctggaaagtcatcttaaagaatataaagagaaatacctctctttagaacagaaaaccgaagagctagaaggtcaaattaagaaactagaagctgatagtcttgaagttaaagcaagcaaggagcaggctttgcaagatctacaacagcaaagacagctgaacacagatttagagctcagagccacagaattgagtaaacaacttgaaatggagaaggaaatagtatccagtacaagattggatctacagaaaaaatctgaagcccttgaaagtatcaagcaaaagcttaccaagcaagaggaagaaaaaaaaatcctgaaacaagattttgaaactttaagtcaagaaacaaagattcagcatgaggaattgaataacagaattcaaacaacagtaacagaactacaaaaagtgaaaatggagaaagaagctttaatgacagagctttctacagtaaaggacaaactatcaaaagtttctgattctttgaaaaactctaaaagtgaatttgaaaaggagaatcagaaaggaaaagccgctatattagacttggaaaaaacttgcaaagaattaaagcatcaacttcaagtgcagatggaaaacacacttaaggaacagaaggaactgaaaaagtcacttgaaaaagagaaggaggcttctcatcagttgaaattggaactcaattcaatgcaggaacaacttatacaggcccagaatactttaaaacaaaatgaaaaagaagagcaacaacttcaggggaacataaatgagctaaagcaatcaagtgaacagaagaaaaaacaaattgaagcactccaaggagagcttaaaattgctgttttacagaagacagagcttgagaataaactacagcagcagttaacacaggcagcccaggaacttgcagcagagaaagagaaaatatcagtattacaaaacaactatgaaaaaagtcaggaaactttcaaacagcttcaatctgatttctatgggagggaatctgaacttctagccaccaggcaagatcttaagtctgtagaagagaagctttctctagcacaggaggacttgatttcaaacagaaatcaaattggaaatcaaaataaattgattcaagaactgaagactgccaaggctacattggagcaggattcagcaaagaaagaacagcaattgcaggagcgatgtaaagcactacaagacattcagaaagaaaagtcactgaaagaaaaagaactggtaaatgagaagtctaaattggcagagatagaagaaattaaatgtagacaagaaaaagaaatcactaaactaaacgaagaactcaagtcccacaaactagaaagcataaaggagataacaaatcttaaagatgctaaacagcttctaattcagcagaaattagaacttcaaggaaaagcggactccctgaaggcagctgttgaacaggagaagagaaatcagcagatactaaaagaccaggtgaaaaaggaagaagaggagctgaagaaagaatttattgagaaagaagctaagttgcattccgaaataaaagaaaaggaagtaggaatgaagaagcatgaagaaaatgaggctaaacttaccatgcagattacagcattaaatgaaaacttaggcactgtgaagaaggagtggcaatctagtcaacggagagttagtgagcttgagaaacaaacggatgacttacggggtgaaattgcagtattagaagcaacggttcagaataatcaagatgaaaggagagcactactggaaagatgtcttaaaggagaaggtgaaatagaaaagcttcaaaccaaagtattagaattgcaaagaaagctggataatacaactgcagcagtgcaggagctgggcagagaaaaccaatcacttcagatcaaacatacacaagcgttgaatagaaagtgggccgaagacaatgaagtacaaaactgtatggcctgtgggaaaggcttttcagtaacagtgagacggcatcactgccgacagtgtggaaatatcttctgtgctgaatgttcagccaaaaatgccttaactccttcctccaagaagcctgttcgtgtctgtgatgcatgtttcaatgacttgcaaggataatgggttatcacaacttcagagtaatattacactaacattagatttttaataaatgtacttaatagaggtcttggactactatttggtttggacactggttgcaatactagaccaaataggaattagtatattttggaatgttatggatatcaagtaaaactcttctatttttgtgagacttgggcttatcatctttcattacttttttcccatttagcccctggaatagctttcatgccaagtttagaattagccaatgaaatgtaaataaactttggacagaaaatagcaatgtatttttttaatataatttcattattcacaaatgaagaatgcaattccatagcttacttctttctcctaaatttaatgtacaaaaatgtacatggatgatattatcacttgttgctgtttttgttgcacaatagcacattaattatattaaatattctctttgtgaagttatgcacagaactgtaacactttcctctgcctttttctcttatatgtgggttcatggttcagttgcattgttatgttatgaatttactacttgggtgttctaaatacagtttatcttaaaatatgtagtaatatgaattcaaaaatggtttttgttttaacaatattaattaaattttcttgggtggattttataaaaacctctgtaaaatcaatttgtttacttatagttatctggggttgtattgcaaagaatagggttaatttttctttttgtctttttctgtctctttcttaaactcccacgcattgtccatttagaatcttagaaagcttcttaccctcgctgtcagttggaggatgaataataaacattgtataatgttcttattctcggtttcttgtaagtgggaagtcttttgagatcagccttcatatcatacccttattttgtctctctagcatcttcaggaacctgagtttgctttttacatagatctgattttttcctttatttggtttaacattttcaagcatagatcagcttcatgtatttgttttataattttgcatcttaaagctagtaactaatattgctgtggtcttattggtgaaaacaaaatataaaatgataagaagacattaaatattttactttctatttcttaccctattgggaagaatttttaaaagttgtaaaattgacttaaagttaaaatggttctgaatttggtgttccatgtcaactgttcccagttttaattttaactttgcaaaaataatgttgtgaaattccctttaagtaactaacacctagaaatagagtatcaccaaaaacaaatgtatttaggaatcccagttacaataaaaactgaaacagcatggctaagcatcttaaggataattaagaaattagcttatttgtatgctgaacaatggaatcgaactttaatttagcatagtcttattaatttggaaaattgtaaaacatctcaagagagaagttattaatattggtttattaatctttctagagaagaagtgtagttatacattcattcagtgcaatcattttataacagtagttaatatttcatttataatagttcttaatatacatttgctttcaaatattctgaaatgaaattatattcatgctatacctacagtgtatgtaaactaaagagatcactacatatttgtttaattatttaaaaaaaaatttaagtaaaccctgttgtcattagctattaagaacattgattaagtccctggacttggataaacatatatccttgaacatatataatgaagaaatacagtggctctttattaaaaataatagttggataatataaactgaactatttatgcatttttatatacttataaatccttccaaatagttttaattctatccttttacatataaataacttaataagtgtgctggaaaaacacagatattcacagcaccactgttttttttttttttttgagataataaattccatgagaaatctgggtttgaatatttgtttactttgtctcctaattgaacaccactccaggccttctgtctgtctcccctttacccccaaaatactcacaaaaaaattttaagacaacaagtaaccatatataggtgtttgaatgattttctcatttttatctaatttcatttcataagtcccgagtaatttacctaccataggctactatactgataatataaatgaaaccgaacattttttgctactaactctccccaatttaatgtgttttcgaaataaaaatttaaatttttttccttttaattaaaaagtcatctttgaagtccttattggctgtacattttacatgtttgctggtactattattttgtcagtcagttaaagctggcatgtacagctcttggctttaatgaaaagcacattgacataatgttagtaaattccaaaccccggcacagaatgtgagttaaaattaagtcttgctgggttagtgtacaataaactatacctacagacttttttttaatagaaagaagacaaagctgctggtataggatttgttcctttgaagaaaaaatgagggaaacaaacacaaaaacctcaatgcagtgtataaataacattttgttcaactacctcttaatgtggaattatctactttaatagtttcctgacagtaatgttaaatagtaactgccaaatttgttattttcccatctctcttaaaaaagtctttatgattattttatatagttttgagaactttaaagccacttttttttaaccttacatttgcataaaaatgtttagcttttaagtagagagcaaattatgatcatatattttgatattcatgacctgtttgactataggagtttttttaaaaaaatgcactttggctataaaaccatggatgatttgatccataagatttaaatgtgccaccattatagtattcctagacatgagcttgatgaatggtattctgtaattataacgtgccacacattattgtgtcttaattgcccttagcctgaattttaatgatcaatttgttattgttgcagatgtgaatattgtgcataaacttactaaatttatgtaaaattgtataaaatagaattagaagtcactaagttctttctgtgtagaagtaataaatttattgtaacacaatgcagttgtgtatatgacattctgtaattccttgaactggatcatatattcataagttctgtagatacttatgcatgaacattttctcatttagtttttgggttcattatttgtattgtgtttactacttgtgatcatgtagttgtgccttactttgtgagaaaggttagctcagtaaatactgcaatttctaaactcagtgattggaaggttattaattataaatgtaactgataaagtacgtgacagcatttaaatctgtataaagaacaatggaaggatccttattgaattgttgcttttttttaatatgtttaaatattatattaaaaacatttctttctaaactagttgtattctgtgactataaattgttttgtctaacaaaagagagaacactgtattaaccattttgcattaatttatttacagaatattaggactttgcacttggatatagacagtggtgttttaatgttgttcaatttcgaatagtaattaaattcctgatctcaagagaaattattaatgccattttgccttagacattccatttaatattgtagagaattaacaaaactaaaaacaaatataaaaaatatgtaattaaccccttatttcattgtgtgtctgcatttaatacccagatgaccatttaaagatacttaaaacattatttatttatttatttatttatttttctccctcccctccccaaagatactttttggaaggcccaatgtgccattgttttttgctattttttcttcctgggagccacggttctagaatggtttttgttctgacccccgtgatcccttcattcgaatgtgcttcattctaaaccctccaaagagtttaatgtgcatatcctcaaacatctaatatattgtatattagacatgttactttgtgagctttatagaattccagtttatgtacagcatattcttgagctgttttatatattttgttaatttagtcagtctgtctctccctttaatgagattcagagggagaaaactacctttatacatgtaagtctgtggttgctggattcatgggactaaaggaatttgagaggccacctcatcctagtccactgctcacctccgaggttagtttatatctaaacatttgcaagatgattgttaatgtaaaaattttttttaaccagaaatttctttataaaatcttctcttgcataatctatattgtattctcctggacataactgctttcagtcccatccagatgccatctctaggaattcacttgaagcttgaagtctattctcccctttttctcccctccacctcatttattcttagctattaacaatagttactgtcctccagattttcctttttttcttctattaaatttctgacattattataaagaggttattagtctccattctaatagtgcttgccttgtacaaaagcctttctgctgcacttgtctttactgctttgtttgcatagtgaaatttcaccttcctcaaggaattactgggcacatgacttgcccaaacattatcctctctaccccattcttcagcttaacaaaatcagctaaggcttcagttgtcttgcagccaaatttgataaatttactactttcactttgcaaattgcaaaaggtacgattctgaaatggaagtttgtggacttccctttgatgcaataatctgaccctaagaactagttccttgaatgtagttaatagtatatatcctgccatgataataattattcaaactgcctttcatgataaaaattctgaagaaatttgaagtcctgccaaataaaattaagtgactgtactgtgctaacacacacacacacacacacacacaccaatcaaaaccagaaagtatttttatggcaaacaccatcattcttcaaaaaataaagttaagagacagataccttactatgtctatgaaaatctgtacacttcacaacaggccaagaaaagccatgcaaaagtgttaactggtgaaagccagattttttttttcttcctatcttaaagtaatggaatttagtctttgggattttctacttccacgttagagtactatatacctgagatgagtttgagaataggaattttaaaactgctacttaaatgtagtccctatttattgctttgtatattaaaagaacaatcaagctttgtatctaaagatttatcattatgtttgaggtaggact

SEQ ID NO: 128925 - DNA, 2542 bp, Homo sapiens
  Payload ID: 5217
  Gene Symbol: EEA1
  Gene Name: early endosome antigen 1
  ENST ID: ENST00000418984
  CDS Start-End: 262-384
gtcagttacgggggctgcccggcgggcgggctggaggcgctcgcaggctgcctagtcgttcgctcgctctctctcgcgtgctccctctcgccgcctgtggggaagtcggggccgcccgagcggccgtcgccaccgcctcgccccgacctccttcccggtcccctcccggcccagtccctcccgcccgcgcaccccgagtagtgagtggccccgcgcagggtctggagagtcaccgcggcggcgccgggtggtggttaaaccatgttaaggaggattttacagaggactcctgggagagttggctctcaaggttctgatttagattcatcagcaactcctataaacacagtggacgtcaataatgaaagctcttcagagagatgatgtaacactgctcagacaagaggtccaagacctacaggcttcacttaaggaagaaaaatggtactcggaagaattaaagaaggaattagaaaaatatcaagggctgcagcagcaagaggccaaacctgatgggttggtgactgattcatcagcagaactacagtctttggaacagcaattagaagaagcccaaacagaaaattttaatattaagcaaatgaaagacttatttgaacagaaagcagcccaacttgctactgaaattgcagatataaagtcaaagtatgatgaagaaaggagtcttcgagaagctgctgaacaaaaagtgacacgtctgacagaagaattaaacaaagaggcaactgtaattcaagatctgaagacggaactgcttcagagacctggtatagaagatgttgccgtgctaaagaaagaactggtccaagttcaaacactaatggataacatgaccttggaacgtgagcgagaatctgaaaaactcaaagatgaatgcaaaaaattgcagtcacaatatgctagctcagaggccacaataagccagctaaggagtgaacttgccaaaggcccccaggaagttgctgtatatgtacaggaactacaaaaactgaaaagttcagttaatgaattaacacaaaaaaatcagaccttgacagaaaacttgctgaaaaaagaacaagactatactaagttagaggagaaacataatgaagaatctgtgagtaaaaagaatattcaggcaacccttcatcaaaaagacctagattgtcaacagcttcagtcaagattgtctgcatctgaaacctcactgcatagaatacatgtagaactaagtgaaaaaggagaagctactcaaaagctcaaagaagaattatctgaggtagagaccaagtaccagcatctaaaggcggagtttaagcagctacaacaacagagagaagaaaaggagcagcatgggttacaactccaaagtgaaattaatcaattacatagcaaacttctggagacagagcgccaactaggggaagctcatggtaggctgaaggaacagagacagctttcaagtgaaaagttgatggataaagaacaacaagtggctgatttacaactcaaactttctcggttagaagagcagttgaaggaaaaagttacaaattctacagaattgcagcatcaattagataaaacaaagcaacagcatcaagaacaacaggctcttcagcaaagcaccacggcaaaacttcgagaagctcagaatgatttggaacaagttctacgtcaaattggcgataaggaccaaaagatccagaaccttgaagctttattacagaagagtaaagaaaatatttcattactagaaaaagaaagagaagatctttatgcaaaaattcaggctggtgaaggagagactgctgttcttaaccagttacaagaaaaaaaccatacactacaggagcaagtaactcaactaacagagaagctgaagaatcagtcagaaagtcataaacaagcccaggagaatttgcatgaccaggtacaagagcagaaggcacatcttagagctgcacaagaccgtgtcctttccctagaaactagtgtcaatgaattaaatagtcaattaaatgaaagcaaggagaaggtctcccagcttgacatacagattaaagccaaaaccgaactattactatcagcagaagcagcaaaaactgctcaaagagctgatcttcagaatcatttggacacagctcaaaatgcattacaagataaacagcaggagttaaataagattactactcagttggatcaggtcactgcaaagttacaagacaagcaagaacattgcagtcagctggaaagtcatcttaaagaatataaagagaaatacctctctttagaacagaaaaccgaagagctagaaggtcaaattaagaaactagaagctgatagtcttgaagttaaagcaagcaaggagcaggctttgcaagatctacaacagcaaagacagctgaacacagatttagagctcagagccacagaattgagtaaacaacttgaaatggagaaggaaatagtatccagtacaagattggatctacagaaaaaatctgaagcccttgaaagtatcaagcaaaagcttacc

SEQ ID NO: 128926 - DNA, 542 bp, Homo sapiens
  Payload ID: 5217
  Gene Symbol: EEA1
  Gene Name: early endosome antigen 1
  ENST ID: ENST00000549790
  CDS Start-End: 415-542
ggattgagagaaagactaaatcaggtctcaagtcttcagtgaatgagaatgatttggaacaagttctacgtcaaattggcgataaggaccaaaagatccagaaccttgaagctttattacagaagagtaaagaaaatatttcattactagaaaaagaaagagaagatctttatgcaaaaattcaggctggtgaaggagagactgctgttcttaaccagttacaagaaaaaaaccatacactacaggagcaagtaactcaactaacagagaagctgaagaatcagtcagaaagtcataaacaagcccaggagaatttgcatgaccaggtacaagagcagaaggcacatcttagagctgcacaagaccgtgtcctttccctagaaactagtgtcaatgaattaaatagtcaattaaatgaaagcaaggagaaggtctcccagcttgacatacagattaaagccaaaaccgaactattactatcagcagaagcagcaaaaactgctcaaagagctgatcttcagaatcatttggacacagctcaa

SEQ ID NO: 128927 - DNA, 558 bp, Homo sapiens
  Payload ID: 5217
  Gene Symbol: EEA1
  Gene Name: early endosome antigen 1
  ENST ID: ENST00000553019
  CDS Start-End: 197-328
gctctctctcgcgtgctccctctcgccgcctgtggggaagtcggggccgcccgagcggccgtcgccaccgcctcgccccgacctccttcccggtcccctcccggcccagtccctcccgcccgcgcaccccgagtagtgagtggccccgcgcagggtctggagagtcaccgcggcggcgccgggtggtggttaaaccatgttaaggaggattttacagaggactcctgggagagttggctctcaaggttctgatttagattcatcagcaactcctataaacacagtggacgtcaataatgaaagctcttcagaggtggagcatccctaatctgaaaattcaaaatccgaaatgctgcaaaattccaaacttgagtgccgaaatgatgttcatttcagattttggatttttttggattaggatgtccaactgggtttcatatgtccccagtgtatgaaatctcttggatctgctgatgaacttttcaaacattatgaagctgttcatgatgctggtaatgactcaggtcatggaggagagtctaatcttgctttgaagcg

SEQ ID NO: 128928 - DNA, 3138 bp, Homo sapiens
  Payload ID: 5218
  Gene Symbol: EGR1
  Gene Name: early growth response 1
  Uniprot ID: P18146
  ENST ID: ENST00000239938
  CDS Start-End: 273-1904
gcgcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattggg

SEQ ID NO: 128929 - DNA, 2968 bp, Homo sapiens
  Payload ID: 5219
  Gene Symbol: EGR2
  Gene Name: early growth response 2
  Uniprot ID: P11161
  ENST ID: ENST00000242480
  CDS Start-End: 327-1757
gagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggacccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattataaactcagagaacagaagtgcaatgtgatgggaggaacatagcaatatctgctccttttcgagttgtttgagaaatgtaggctattttttcagtgtatatccactcagattttgtgtatttttgatgtacactgttctctaaattctgaatctttgggaaaaaatgtaaagcatttatgatctcagaggttaacttatttaagggggatgtacatatattctctgaaactaggatgcatgcaattgtgttggaagtgtccttggtgccttgtgtgatgtagacaatgttacaaggtctgcatgtaaatgggttgccttattatggagaaaaaaaatcactccctgagtttagtatggctgtatatttctgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagataatggatggtttgtgactatagtgtaaataaatacttttcaacaata

SEQ ID NO: 128930 - DNA, 2872 bp, Homo sapiens
  Payload ID: 5219
  Gene Symbol: EGR2
  Gene Name: early growth response 2
  Uniprot ID: P11161
  ENST ID: ENST00000411732
  CDS Start-End: 388-1668
aactgagcgaggagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggacccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattataaactcagagaacagaagtgcaatgtgatgggaggaacatagcaatatctgctccttttcgagttgtttgagaaatgtaggctattttttcagtgtatatccactcagattttgtgtatttttgatgtacactgttctctaaattctgaatctttgggaaaaaatgtaaagcatttatgatctcagaggttaacttatttaagggggatgtacatatattctctgaaactaggatgcatgcaattgtgttggaagtgtccttggtgccttgtgtgatgtagacaatgttacaaggtctgcatgtaaatgggttgccttattatggagaaaaaaaatcactccctgagtttagtatggctgtatatttctgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagataatggatggtttgtgactatagtgtaaataaatacttttc

SEQ ID NO: 128931 - DNA, 2844 bp, Homo sapiens
  Payload ID: 5219
  Gene Symbol: EGR2
  Gene Name: early growth response 2
  Uniprot ID: P11161
  ENST ID: ENST00000439032
  CDS Start-End: 210-1640
gatgcagcgtagctcttagggggaggtgtgagtccttggaaagctcacaagaatttcagaggggcccgagatgcgagtcggactcccttccgaggcgtcgtcttgcccatggtcagcgcgggggccgcgggacccgccagagcgcaggcggagtgggctggcgcacgtggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggacccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattataaactcagagaacagaagtgcaatgtgatgggaggaacatagcaatatctgctccttttcgagttgtttgagaaatgtaggctattttttcagtgtatatccactcagattttgtgtatttttgatgtacactgttctctaaattctgaatctttgggaaaaaatgtaaagcatttatgatctcagaggttaacttatttaagggggatgtacatatattctctgaaactaggatgcatgcaattgtgttggaagtgtccttggtgccttgtgtgatgtagacaatgttacaaggtctgcatgtaaatgggttgccttattatggagaaaaaaaatcactccctgagtttagtatggctgtatatttctgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagataatggatggtttgtgactatagtgtaaataaatacttttc

SEQ ID NO: 128932 - DNA, 4336 bp, Homo sapiens
  Payload ID: 5220
  Gene Symbol: EGR3
  Gene Name: early growth response 3
  Uniprot ID: Q06889
  ENST ID: ENST00000317216
  CDS Start-End: 359-1522
gatcaatactgaggccgcgtccgacccccttgagccgagatccccccccagcccagcccccaccccaccccccgcacacgccccaccccccccacgacccagcctcataccgcaccagctgaggcacccaagaggattaccccctggggccctctcccgccccccaaaaaagagaagatcccctctcctggcccatcccttcccttcttccctcccccctccccccgaactttccctctcgcatgcttttcccctgcaccacggatcgcctctcggatgccgcttgcctggaagctgcgttaggagcgagcggcggcggtggcggcggtggcggcggcggcggcagctcgggagtgctatgaccggcaaactcgccgagaagctgccggtgaccatgagcagtttgctaaaccaactgcctgacaatctgtaccccgaggagatccccagcgcgctcaacctcttctccggcagcagcgactcggtagtccattacaatcagatggctacagagaatgtaatggacatcggtctgaccaacgagaagcccaacccggaactctcttactccggctccttccagccagcccccggcaacaagaccgtgacctacttgggaaagttcgccttcgactccccttccaactggtgccaggacaacatcattagcctcatgagcgccggcatcttgggggtgcccccggcttcaggggcgctcagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctgctagcctgaaagcagcgggaaagccagccacggaggcgtaggggccgcgccctggcctctccatggacgtgcggccccttgcttccccttcgatgcccccggttcccaacctttcacgccggccagcggtcaggggccagggctggaggcgccttcccctcgcggtcccccacttagccaaggcgtgggggcggaaaggtggcgtctagcccgctttgttcagttcggatcgccttgatccaggggccgccgggccgcgccaaggacctgcaagggactgaaggcggagcccatccaaccctcgcccgacccaaacacctcattgtttcccccacgtctccctctataccccctcgaagactcgagagggggagggggtaaggagcgcaccaaagcgcagagcttgctgcccgccgcacgcacgcgcgcctgcgtgcggggatgcgcgcgagtgtgtgcgtgctcgcgtgtgtgtgtatgtgtgtgtgtgagtgtgtgtgtgtgcgcgcgcgcaagcgtgtgtgtttaagactcttgagctgaactgggctgtgtttaccccaaactcttccccacctcgggtccccaagccgctgggagatgtcccatgctgggggtccgcacgtggctggaggaggtggtcttccatccgctctgaaatcatgtttcttagagaaatgcctcggatgccgccgacgcggtgctgctgccgccgcttcgggtttggcccctcagaacccctccttttctgagcgcttccctcttaggcctcagggcagtttgatctgtggggagaaagagcagccatcgctgagcctgccttttaaaatatatgtgtatttccttagccccactctaagaaatctatgttcctgagtttgccccctgccctcccactccttccccttctcccctctaaaccttctcccatctctttcaaaatcttttcccagaaaggcaggcttcaaccagccactccagctttgtgtcttctctcaattacatagcaatttctccttcccaccatcatggggaagctggctctgcttttgccctttgtcatcaccaacacaacagatagaatttaaatataagtatatggtgtgcgtgtgtatgtatgtgtatgtatatgcatgcatgtgtataaagatgcacatgcgtacatatacataacatacacacaatatgtattcctagcaaaataaaatctctaaggtacttggttatccagtgcagtgcaccggaataaagagaatttgtaggcgtatacagctttaaatgatttattttttatgaaaatgttaactgatgagattatatctacatacgtgtgttatgtgtgtggatatagatgcacacatatctgtacatatacatgtgagtgtacatatatacacatatacacatctatgtatggatatgtgtgtatacacatatacacatctctgtccaaaatttcctcaaagatatggggattttttcatgaatccatgtggatgaatgaggtgtctcctttccatacccagtctcaccttctccccaccctacctcacctcttctcaggcacccctcttccccagctgtcctgccagcccttctcgtacagggtggctcctttgaagtggagtaatagggaaggttgctctctgccacagcttgcagcatggtcttgactgaatgtactgttcctgttagcgttacttctcctgtggtcagtaagttgcccagagagaaggaacaaaggtctggagtttacagaatgtctgtttttaaagtcactttatgcgttttccacttttttcttttttaagaaaaagaagtaccatttttgttttgttttgttttgatttttggtggtggataaataatactaaaaggactctagtggaaaggggggatatcgaagagcagggggttgtgaatttccaggtacttggactttttgtagaaggagagagaagaagatgaagtttgccaggagggcccatattttttcagctgaagggtaaaatctttctttgcagagacagtattttgctgaatactttttataatgtgatgattattaaaaaagcaaaaattttggtcacttccaagctagaaggaggaatcagataccctttaatattttttcctcgctccttctggtatatgcatgtcactgcatgataattgagttttcctttgttttaataaaactgttctcagacattaagctaaactaagagaaaaataactttgttgccaaaaggttgtgctatccagattttttatatgtctgcatgtttaaaaaaaaaaagcaacaaaagaaaatgcactctaacttatgtgaactgagagaaaaaaatcaggttttaaacaggaaaacctatggggaatgatattttttgaaagacttttgtataaagttgagtacttagaaaaaagacaaaccagatgtaatatattttgtggatgtttttatttcttggatttatagtaccttatactaaggttaaaaaaatatgcttgatattgtgaaaaggtgaaattcttcaccaacatttcatttgctcctttgtcatattgtaatgccaatataatatagttaatgaaaacagcatttttaaaaaccgaaatattgaaatggtgtaatgttgtaccatttgcactgtgagcaaatgctaatacagtaaatatattgtgtttgctgacaatcagccggcctataaatctccttattttatttcttgtttttatagcataaagctttagtttggcctgtt

SEQ ID NO: 128933 - DNA, 1500 bp, Homo sapiens
  Payload ID: 5220
  Gene Symbol: EGR3
  Gene Name: early growth response 3
  ENST ID: ENST00000519492
  CDS Start-End: 235-450
cacccaagaggattaccccctggggccctctcccgccccccaaaaaagagaagatcccctctcctggcccatcccttcccttcttccctcccccctccccccgaactttccctctcgcatgcttttcccctgcaccacggatcgcctctcggatgccgcttgcctggaagctgcgttaggagcgagcggcggcggtggcggcggtggcggcggcggcggcagctcgggagtgctatgaccggcaaactcgccgagaagctgccggtgaccatgagcagtttgctaaaccaactgcctgacaatctgtaccccgaggagatccccagcgcgctcaacctcttctccggcagcagcgactcggtagtccattacaatcagatggctacagcctcccacccgggatggagccatgtgcggcgtggagtccccgcggtgggagagagaatgtaatggacatcggtctgaccaacgagaagcccaacccggaactctcttactccggctccttccagccagcccccggcaacaagaccgtgacctacttgggaaagttcgccttcgactccccttccaactggtgccaggacaacatcattagcctcatgagcgccggcatcttgggggtgcccccggcttcaggggcgctcagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctg

SEQ ID NO: 128934 - DNA, 1553 bp, Homo sapiens
  Payload ID: 5220
  Gene Symbol: EGR3
  Gene Name: early growth response 3
  Uniprot ID: Q06889
  ENST ID: ENST00000522910
  CDS Start-End: 74-1123
ctcttcccgggaggagcccggcgtctttttcacccgcgctctccccccttactccctcagcctcccacccgggatggagccatgtgcggcgtggagtccccgcggtgggagagagaatgtaatggacatcggtctgaccaacgagaagcccaacccggaactctcttactccggctccttccagccagcccccggcaacaagaccgtgacctacttgggaaagttcgccttcgactccccttccaactggtgccaggacaacatcattagcctcatgagcgccggcatcttgggggtgcccccggcttcaggggcgctcagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctgctagcctgaaagcagcgggaaagccagccacggaggcgtaggggccgcgccctggcctctccatggacgtgcggccccttgcttccccttcgatgcccccggttcccaacctttcacgccggccagcggtcaggggccagggctggaggcgccttcccctcgcggtcccccacttagccaaggcgtgggggcggaaaggtggcgtctagcccgctttgttcagttcggatcgccttgatccaggggccgccgggccgcgccaaggacctgcaagggactgaaggcggagcccatccaaccctcgcccgacccaaacacctcattgtttcccccacgtctccctctataccccctcgaagactcgagagggggagggggtaa

SEQ ID NO: 128935 - DNA, 2377 bp, Homo sapiens
  Payload ID: 5221
  Gene Symbol: EGR4
  Gene Name: early growth response 4
  ENST ID: ENST00000436467
  CDS Start-End: 389-1849
ttttcgggagtccccggcacacatcctgtgtccatgtttgggcatttacgtcacggcggcagggccggggcctcccaaaatggcagtggcccggggagtcggaagcccggagccagcgccgccgcagctatataagtgggggggctgtgggctgggggagcccggcagcgctttggagaggcgaggagccgccgcccgaggccggtgcgggcgagcgagggcgccgcggctccccgactcctttcccagaggtgagtgcccgaagccaggagcccgggcgcctaggtctgtgcgctgcggggaacccctaccgccagcctccccgccacccgcgcgcccccaagcccagcgggcgaggccccgggcgccccacagccggcgccgcgccatgctccaccttagcgagttttccgaacccgacgcgctcctcgtcaagtccactgaaggctgttgcgccgaacccagcgctgaattgccccggctgcctgccagggacgctcccgcggccaccggctaccctggagcaggcgacttcttgagctgggctttgaacagctgcggcgcaagtggggacttagccgactcctgcttcctggaggggcctgcgcccacaccccctcccggcctcagctacagcggtagcttcttcattcaggcagtgcccgaacacccgcacgacccggaggcactcttcaacctcatgtcgggcatcttaggcctggcacccttccccggtccagaggcagcagcgtccagatccccgctggatgccccttttcctgcggggtccgatgccttgctgccgggtccgccggacctttactccccggatctgggcgctgcccctttcccagaggcgttctgggaggcctcgccttgcgcgggtgccccctcgcagtgcctgtatgagcctcagctctccccgcccgacgtcaagcccggcctccgggcgcctcccgcctcgccagcgctggacgctgtctctgccttcaagggtccctacgcgccctgggagctgctttctgtgggggccccagggaactgtgggtcacagggagactaccaggccgccccggaggctcgttttcccgtaatagggaccaagattgaggacttgctgtccatcagctgccctgcggaactgccggccgtcccagccaacagactctatcccagcggggcctatgacgctttcccgctggccccgggtgacttaggggagggggctgagggcctccctgggctcctgacccctcctagtggggagggagggagtagcggcgacggcggagagtttctggccagtacgcagcctcagctttccccgctgggccttcgcagcgccgccgcggcggacttccctaaacctctggtggcggacatccctggaagcagtggcgtggctgcaccacccgtgccgccgccgccgcccacccctttcccccaggccaaggcgcgacgcaaggggcgccgcggcggcaaatgcagcacgcgctgcttctgcccgcggccgcacgccaaggccttcgcttgcccggtggagagttgtgtgcggagctttgcgcgctccgacgagctcaatcgccacctgcgcatccacacgggccacaaacccttccagtgccgcatctgcctccgcaacttcagccgcagcgaccacctcaccacgcacgtgcgcacccacaccggcgagaagccttttgcttgcgacgtgtgcggccgccgcttcgcgcgcagcgatgagaagaaacggcacagcaaggtgcacctcaagcagaaggcgcgcgccgaggagcggctcaagggcctcggcttttactcgctgggcctctccttcgcttctctctgagcaagagatgggtttatgggttggggcgccgccgttcggcgcgcacgagttccgggccgttcccctccccgctcttcttccaactcctcctcgcacgcccgagggccggcctccggtcccgcttccagtttccttgaagcgcccgccgcacacgccctattcagcaccagctccgcggacagttcccgcggtccaggcgctgtcacccttgtcagccgcgctttgggggaagtcttctgagaccacccagtgaataggcactaccctgggattcaagacagtcttttgtaactggcacacgccccacgccttcctctataacccccagagacaggctggggcagcgccaaggcggtctcgcgcgggactttgtacagcagtgtcttatccagcagccattggatgtaacgttttgctttgggttttttttccttttgttgttgttaatttttgtaaagcagacgctactctcaagcagttgacaaaactgtttatttttgcaattaaaattattgtgctaaaagctta

SEQ ID NO: 128936 - DNA, 2372 bp, Homo sapiens
  Payload ID: 5221
  Gene Symbol: EGR4
  Gene Name: early growth response 4
  Uniprot ID: Q05215
  ENST ID: ENST00000545030
  CDS Start-End: 76-1845
cgggagtccccggcacacatcctgtgtccatgtttgggcatttacgtcacggcggcagggccggggcctcccaaaatggcagtggcccggggagtcggaagcccggagccagcgccgccgcagctatataagtgggggggctgtgggctgggggagcccggcagcgctttggagaggcgaggagccgccgcccgaggccggtgcgggcgagcgagggcgccgcggctccccgactcctttcccagaggtgagtgcccgaagccaggagcccgggcgcctaggtctgtgcgctgcggggaacccctaccgccagcctccccgccacccgcgcgcccccaagcccagcgggcgaggccccgggcgccccacagccggcgccgcgccatgctccaccttagcgagttttccgaacccgacgcgctcctcgtcaagtccactgaaggctgttgcgccgaacccagcgctgaattgccccggctgcctgccagggacgctcccgcggccaccggctaccctggagcaggcgacttcttgagctgggctttgaacagctgcggcgcaagtggggacttagccgactcctgcttcctggaggggcctgcgcccacaccccctcccggcctcagctacagcggtagcttcttcattcaggcagtgcccgaacacccgcacgacccggaggcactcttcaacctcatgtcgggcatcttaggcctggcacccttccccggtccagaggcagcagcgtccagatccccgctggatgccccttttcctgcggggtccgatgccttgctgccgggtccgccggacctttactccccggatctgggcgctgcccctttcccagaggcgttctgggaggcctcgccttgcgcgggtgccccctcgcagtgcctgtatgagcctcagctctccccgcccgacgtcaagcccggcctccgggcgcctcccgcctcgccagcgctggacgctgtctctgccttcaagggtccctacgcgccctgggagctgctttctgtgggggccccagggaactgtgggtcacagggagactaccaggccgccccggaggctcgttttcccgtaatagggaccaagattgaggacttgctgtccatcagctgccctgcggaactgccggccgtcccagccaacagactctatcccagcggggcctatgacgctttcccgctggccccgggtgacttaggggagggggctgagggcctccctgggctcctgacccctcctagtggggagggagggagtagcggcgacggcggagagtttctggccagtacgcagcctcagctttccccgctgggccttcgcagcgccgccgcggcggacttccctaaacctctggtggcggacatccctggaagcagtggcgtggctgcaccacccgtgccgccgccgccgcccacccctttcccccaggccaaggcgcgacgcaaggggcgccgcggcggcaaatgcagcacgcgctgcttctgcccgcggccgcacgccaaggccttcgcttgcccggtggagagttgtgtgcggagctttgcgcgctccgacgagctcaatcgccacctgcgcatccacacgggccacaaacccttccagtgccgcatctgcctccgcaacttcagccgcagcgaccacctcaccacgcacgtgcgcacccacaccggcgagaagccttttgcttgcgacgtgtgcggccgccgcttcgcgcgcagcgatgagaagaaacggcacagcaaggtgcacctcaagcagaaggcgcgcgccgaggagcggctcaagggcctcggcttttactcgctgggcctctccttcgcttctctctgagcaagagatgggtttatgggttggggcgccgccgttcggcgcgcacgagttccgggccgttcccctccccgctcttcttccaactcctcctcgcacgcccgagggccggcctccggtcccgcttccagtttccttgaagcgcccgccgcacacgccctattcagcaccagctccgcggacagttcccgcggtccaggcgctgtcacccttgtcagccgcgctttgggggaagtcttctgagaccacccagtgaataggcactaccctgggattcaagacagtcttttgtaactggcacacgccccacgccttcctctataacccccagagacaggctggggcagcgccaaggcggtctcgcgcgggactttgtacagcagtgtcttatccagcagccattggatgtaacgttttgctttgggttttttttccttttgttgttgttaatttttgtaaagcagacgctactctcaagcagttgacaaaactgtttatttttgcaattaaaattattgtgctaaaagctt

SEQ ID NO: 128937 - DNA, 1322 bp, Homo sapiens
  Payload ID: 5222
  Gene Symbol: EBNA1BP2
  Gene Name: EBNA1 binding protein 2
  Uniprot ID: Q99848
  ENST ID: ENST00000236051
  CDS Start-End: 143-1063
gcgattcggtggcacgtggagccacggcgtgggagtagggggctgaaggcaggcagcagcggccagggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacacatacctttggttaaatagtctagactaaaagattgagaagttactttccattgctatctattgataatttagacattgagttcaaattgccttcattttatgataaataatgatttaactga

SEQ ID NO: 128938 - DNA, 1503 bp, Homo sapiens
  Payload ID: 5222
  Gene Symbol: EBNA1BP2
  Gene Name: EBNA1 binding protein 2
  ENST ID: ENST00000431635
  CDS Start-End: 150-1235
cctcccccggggtcctcctccgcgccaccccacccccgcggctcctttttctgccttttcctttgtaccctcactgctaccagctccttctggcgacccccaggtaccccctcccacctttcgtttctctctgggtcagcagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacacatacctttggttaaatagtctagactaaaagattgagaagttactttccattgctatctattgataatttagacattgagttcaaattgccttcattttatgataaataatgatttaactgacaccttctc

SEQ ID NO: 128939 - DNA, 3069 bp, Homo sapiens
  Payload ID: 5223
  Gene Symbol: ECD
  Gene Name: ecdysoneless homolog (Drosophila)
  Uniprot ID: O95905
  ENST ID: ENST00000372979
  CDS Start-End: 208-2142
caaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttcatttctagtttagattactcatttagtaaaaatgtttcttcattacaagttttacagattgacttctccatgagccccaaatgtggccctcttggcacaagtctttgtgatctcagctgtgggttatacacaggttttgaactcggcagggtagaatctagcccctagacaaccttgagatgaaattcacacacttcatgctaaagacataccctaccacaatatacccttggagtaattctaaatatttaaatttctcccttactgctattcatcctcagatcaaaatttcaagttgacaaatttggatttgaaaactcattcactttttcaatttttttaatgaggcataacatgcatatggttaagtgcacaaatcttaagtgtacagtcagtgaatttttgcatgtatgtatgtacctgaagcaagatatagaacttatttacttgtaaataacagctatattgatatgtcacataccaaaaaatttaccctttaaattatacaattcagtggtttttagtatatttacaaaattgtgcaaccatccctaccatctaattctagaatattagaaaccccatactcactaatagtctctcattcccttctactcccagcccctagaaaccactagtctactttctgtctctatggatttgcctattttggatatttcatacctgatactgtacttaattgttttaattaattaattggtttgatatttaatataactgatatatcttttgctaagatgaaatgtttatttcttaaaatgatgctcatattcctcctaaaataaatcaagtattatctatatatcataaaattcaccattaaaagcaaaaaaaaagtcttctttaca

SEQ ID NO: 128940 - DNA, 884 bp, Homo sapiens
  Payload ID: 5223
  Gene Symbol: ECD
  Gene Name: ecdysoneless homolog (Drosophila)
  ENST ID: ENST00000453402
  CDS Start-End: 248-884
aaaatgctcccgccgacgcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccgaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggc

SEQ ID NO: 128941 - DNA, 2084 bp, Homo sapiens
  Payload ID: 5223
  Gene Symbol: ECD
  Gene Name: ecdysoneless homolog (Drosophila)
  Uniprot ID: O95905
  ENST ID: ENST00000454759
  CDS Start-End: 220-2025
agtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttca

SEQ ID NO: 128942 - DNA, 2246 bp, Homo sapiens
  Payload ID: 5223
  Gene Symbol: ECD
  Gene Name: ecdysoneless homolog (Drosophila)
  Uniprot ID: O95905
  ENST ID: ENST00000430082
  CDS Start-End: 213-2246
acacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaaggttggaggtgcagtggcgcgatcctggcttactgcaagctccacctcctgggttcacgccattcatctgcctcagcctcctgagtacctgggacaacagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaa

SEQ ID NO: 128943 - DNA, 877 bp, Homo sapiens
  Payload ID: 5223
  Gene Symbol: ECD
  Gene Name: ecdysoneless homolog (Drosophila)
  ENST ID: ENST00000413026
  CDS Start-End: 227-877
gcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctg

SEQ ID NO: 128944 - DNA, 1679 bp, Homo sapiens
  Payload ID: 5223
  Gene Symbol: ECD
  Gene Name: ecdysoneless homolog (Drosophila)
  ENST ID: ENST00000484976
  CDS Start-End: 101-592
cagctctcgatcagctctcgcagtcggagaggcggctaaggaaaggtgccacagcagagacgcgaaggagaggccctagaaccgaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttca

SEQ ID NO: 128945 - DNA, 457 bp, Homo sapiens
  Payload ID: 5223
  Gene Symbol: ECD
  Gene Name: ecdysoneless homolog (Drosophila)
  ENST ID: ENST00000494307
  CDS Start-End: 1-262
atctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaaacggagtctctctctgttgcccaggctggagtgcagtggcgctatcttggctcaatgcaagctccacctcccaggttcacgccattctcctgcctcagcctcctgagtagctgggactacaggcgcccgccaccatgcccggctaattttttgtattttttagtagagacagggtttcaccgtgtcagccaggatggtctcgatctcctgatcttgtgatccacccgccttggccccccaaagtgctgggattacaggtgtgagccactgtgcccggccgagttaaatatatttctaacatagta

SEQ ID NO: 128946 - DNA, 4535 bp, Homo sapiens
  Payload ID: 5224
  Gene Symbol: EML1
  Gene Name: echinoderm microtubule associated protein like 1
  Uniprot ID: O00423
  ENST ID: ENST00000262233
  CDS Start-End: 140-2587
atggtaaccggcagcagcagccgccacagcagggccggccccagcgccagcgccggtcgcggtcgggctcagctcagtgtgtggtgagcggcggcggcgcggccgggccggggagcgggcgcggcccggcggcctcagcatggaggacggcttctccagctacagcagcctgtacgacacgtcctcgctgctccagttctgcaacgatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggggtcaggaaagaaactgctgtgccagcaaccaaaagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaagcaaacccaaggagcctgtattcagtgcagaagaaggctatgtaaaaatgtttcttcgtggacgccctgttaccatgtacatgcccaaagatcaagtggattcttacagcttggaagcaaaagtagaacttccaaccaagagactcaagctggaatgggtctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtgcctagcagttcatcctgatcggatcacgatagcaacaggacaagttgcgggcacatcgaaggatggaaaacaattgcccccacatgtgcgcatctgggattctgtgacattgaatactctccacgtcattggaataggtttttttgaccgagcagtcacctgtattgcattctcaaaatctaatggaggaaccaatctctgtgctgtggatgactccaacgaccatgtgctctctgtatgggactggcagaaagaagaaaaactagcagatgtgaagtgctctaatgaagctgtgtttgctgcggatttccaccccacggacaccaacatcatagttacttgtggaaaatcacatctctacttttggacactagaaggaagctcccttaataagaagcaaggattattcgagaaacaagaaaagccaaagtttgtcctctgtgtgactttctctgaaaacggtgacaccattactggagattcaagtggcaacatcttagtatggggaaaaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggagattccagaacagtttggtccaatacggacagtggccgaggggaaaggcgatgtgatcttgattggcacaactcgaaactttgtcctgcagggcactctgtcaggggacttcacacccattactcagggtcacactgatgagctctggggactggccatccatgcctcaaaatctcagttcttgacctgtgggcatgacaagcatgccactctctgggacgctgtgggtcaccgtcccgtctgggacaaaataatagaggatccagctcagtcttctggttttcatccttcagggtctgtggttgcagtcggaacactcactgggaggtggtttgtgtttgacacagaaacaaaagacttggtcaccgttcacacagatggaaacgaacagctctctgtaatgcgatactcaccagatgggaatttcttagccataggctcacatgacaactgcatctatatatatggcgttagtgacaacgggaggaagtacacgcgagtgggcaagtgctcgggtcattccagcttcattactcacctggactggtctgtaaactcacagttcctcgtgtcaaattccggagactacgaaatcctctactgggttccctctgcctgtaagcaagtcgtaagtgtggaaactacaagagacattgaatgggctacctatacctgcactttgggattccatgtttttggagtgtggccagaaggctcggacggaaccgacatcaatgccgtctgtcgggcccatgagaagaaactcctgtcaacaggcgacgactttggcaaagtgcacctcttctcatacccctgctcgcagttcagggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatggtcacagaatgccttttaaaacattgtatataatcttcactgtttcaccatctagcttgctaagtcaaatatttatgatgataatgaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacacccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtggatttcttattgacctatattcatgaaagcatataaattaaaatatttaaaattagatatgattcacactatattctgtttcatatgcagattttattctcacctgggccatttgcagatgagactgtagtttgcagatgagactgtagtttgcagatggcgtggaagcattcatcaggggagataaccataaaggatttggcctaattaccatactcaattgtcagtttacgtggttttgtgaatactggcaaaagcaattgtttttaaattaacaatggagagaatgataagatgagggaaggaaaaggcattcattattgacttacatgtcagtaaggtctgcttttatttctatgtactcctgtttgccaagctcaataatggacaaaggatacaaacacacacacatctactattttagataaatgtactgttatatatatatgtaaactactattgctctctttataatgattaatcactttattatgaatgaatgaatgaatttgatggatttaaaa

SEQ ID NO: 128947 - DNA, 3715 bp, Homo sapiens
  Payload ID: 5224
  Gene Symbol: EML1
  Gene Name: echinoderm microtubule associated protein like 1
  ENST ID: ENST00000327921
  CDS Start-End: 1092-3503
tccatggcttagaaggctttgcatcttgaacatcctggatgcagagcggtcacaggccatccccacagataggttcctacagatggggtgtgtgaccatgttctctcctcctccacacccctctggggcttacagctaccaaagcccaaaatccttcagggctcaggcctcagggctaaacagtgattcacagactttcacacttccccacacacccccgcgcatgccaactttttgtttcggtaaataaagacattcaaaagtaatgaccatctactctggccctcatttcataaaagcaaggctactttatcaccaatgtcagatgaacaatctcagaataaggctaagttctaaaattaaaatacattttatttcatgacaaactccctctacattttcctcactattctgtagacaggcactggggagcctcccacacagctagggcccctggagcacaggctgcaaagaccccaggaggtcccagaatctacctgccttaggcccagagaggggtggacgttgcccaggaccatgccgctggaacaggaaaaaggttttccagttttaccccaggcaattctccatcaaaatgccatctgactacaaagaggcaggcacttgcttccggatcccctctctgctctgcagaactcccaggccacggagctgatttcactaactgcagccgtccccctggggcgccccgtctgccctacttgccatcacccagatgcgcaggatcttgtggcagaaagcaggagcctggatgggaagaggagcagccaggccgaggtgggcgccgctccccctccccggccctgcccaggtcctcagagagctgggacctgagactcattagtgcctgcataatggatgcctccttctctcttcttggaaatccccagcccatcttgcttaatggccacgagggaagtgggataccggcgctctgctcgtaaagccggcctctgccccccgcatctccccttggaggaggggcggctgggcggcttacacaggggaggcctggtctcttgtcttctgcttcacgacggctggatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggggtcaggaaagaaactgctgtgccagcaaccaaaagattaaacagatctgtgagtcttctcaatgcttgcaaactgaatagatcgacaccaagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaagcaaacccaaggagcctgtattcagtgcagaagaaggctatgtaaaaatgtttcttcgtggacgccctgttaccatgtacatgcccaaagatcaagtggattcttacagcttggaagcaaaagtagaacttccaaccaagagactcaagctggaatgggtctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtgcctagcagttcatcctgatcggatcacgatagcaacaggacaagttgcgggcacatcgaaggatggaaaacaattgcccccacatgtgcgcatctgggattctgtgacattgaatactctccacgtcattggaataggtttttttgaccgagcagtcacctgtattgcattctcaaaatctaatggaggaaccaatctctgtgctgtggatgactccaacgaccatgtgctctctgtatgggactggcagaaagaagaaaaactagcagatgtgaagtgctctaatgaagctgtgtttgctgcggatttccaccccacggacaccaacatcatagttacttgtggaaaatcacatctctacttttggacactagaaggaagctcccttaataagaagcaaggattattcgagaaacaagaaaagccaaagtttgtcctctgtgtgactttctctgaaaacggtgacaccattactggagattcaagtggcaacatcttagtatggggaaaaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggagattccagaacagtttggtccaatacggacagtggccgaggggaaaggcgatgtgatcttgattggcacaactcgaaactttgtcctgcagggcactctgtcaggggacttcacacccattactcagggtcacactgatgagctctggggactggccatccatgcctcaaaatctcagttcttgacctgtgggcatgacaagcatgccactctctgggacgctgtgggtcaccgtcccgtctgggacaaaataatagaggatccagctcagtcttctggttttcatccttcagggtctgtggttgcagtcggaacactcactgggaggtggtttgtgtttgacacagaaacaaaagacttggtcaccgttcacacagatggaaacgaacagctctctgtaatgcgatactcaccagatgggaatttcttagccataggctcacatgacaactgcatctatatatatggcgttagtgacaacgggaggaagtacacgcgagtgggcaagtgctcgggtcattccagcttcattactcacctggactggtctgtaaactcacagttcctcgtgtcaaattccggagactacgaaatcctctactgggttccctctgcctgtaagcaagtcgtaagtgtggaaactacaagagacattgaatgggctacctatacctgcactttgggattccatgtttttggagtgtggccagaaggctcggacggaaccgacatcaatgccgtctgtcgggcccatgagaagaaactcctgtcaacaggcgacgactttggcaaagtgcacctcttctcatacccctgctcgcagttcagggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggatcagcggttccgtgttcacttttgttgtacaatatatgacacagt

SEQ ID NO: 128948 - DNA, 4064 bp, Homo sapiens
  Payload ID: 5224
  Gene Symbol: EML1
  Gene Name: echinoderm microtubule associated protein like 1
  Uniprot ID: O00423
  ENST ID: ENST00000334192
  CDS Start-End: 135-2639
aaccggcagcagcagccgccacagcagggccggccccagcgccagcgccggtcgcggtcgggctcagctcagtgtgtggtgagcggcggcggcgcggccgggccggggagcgggcgcggcccggcggcctcagcatggaggacggcttctccagctacagcagcctgtacgacacgtcctcgctgctccagttctgcaacgatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggggtcaggaaagaaactgctgtgccagcaaccaaaagattaaacagatctgtgagtcttctcaatgcttgcaaactgaatagatcgacaccaagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaagcaaacccaaggagcctgtattcagtgcagaagaaggctatgtaaaaatgtttcttcgtggacgccctgttaccatgtacatgcccaaagatcaagtggattcttacagcttggaagcaaaagtagaacttccaaccaagagactcaagctggaatgggtctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtgcctagcagttcatcctgatcggatcacgatagcaacaggacaagttgcgggcacatcgaaggatggaaaacaattgcccccacatgtgcgcatctgggattctgtgacattgaatactctccacgtcattggaataggtttttttgaccgagcagtcacctgtattgcattctcaaaatctaatggaggaaccaatctctgtgctgtggatgactccaacgaccatgtgctctctgtatgggactggcagaaagaagaaaaactagcagatgtgaagtgctctaatgaagctgtgtttgctgcggatttccaccccacggacaccaacatcatagttacttgtggaaaatcacatctctacttttggacactagaaggaagctcccttaataagaagcaaggattattcgagaaacaagaaaagccaaagtttgtcctctgtgtgactttctctgaaaacggtgacaccattactggagattcaagtggcaacatcttagtatggggaaaaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggagattccagaacagtttggtccaatacggacagtggccgaggggaaaggcgatgtgatcttgattggcacaactcgaaactttgtcctgcagggcactctgtcaggggacttcacacccattactcagggtcacactgatgagctctggggactggccatccatgcctcaaaatctcagttcttgacctgtgggcatgacaagcatgccactctctgggacgctgtgggtcaccgtcccgtctgggacaaaataatagaggatccagctcagtcttctggttttcatccttcagggtctgtggttgcagtcggaacactcactgggaggtggtttgtgtttgacacagaaacaaaagacttggtcaccgttcacacagatggaaacgaacagctctctgtaatgcgatactcaccagatgggaatttcttagccataggctcacatgacaactgcatctatatatatggcgttagtgacaacgggaggaagtacacgcgagtgggcaagtgctcgggtcattccagcttcattactcacctggactggtctgtaaactcacagttcctcgtgtcaaattccggagactacgaaatcctctactgggttccctctgcctgtaagcaagtcgtaagtgtggaaactacaagagacattgaatgggctacctatacctgcactttgggattccatgtttttggagtgtggccagaaggctcggacggaaccgacatcaatgccgtctgtcgggcccatgagaagaaactcctgtcaacaggcgacgactttggcaaagtgcacctcttctcatacccctgctcgcagttcagggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatggtcacagaatgccttttaaaacattgtatataatcttcactgtttcaccatctagcttgctaagtcaaatatttatgatgataatgaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacacccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtgg

SEQ ID NO: 128949 - DNA, 480 bp, Homo sapiens
  Payload ID: 5224
  Gene Symbol: EML1
  Gene Name: echinoderm microtubule associated protein like 1
  ENST ID: ENST00000555096
  CDS Start-End: 65-322
agtgtgtggtgagcggcggcggcgcggccgggccggggagcgggcgcggcccggcggcctcagcatggaggacggcttctccagctacagcagcctgtacgacacgtcctcgctgctccagttctgcaacgatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagaccactgatgcagaccctgcctttaagaaccacggtcaacaatggcactgtgttaccaaagaaacctactggctctctaccatccccctccggggtcaggaaagaaactgctgtgccagcaaccaaaagtaacatcaagaggaccagctcttctgaacgagtgtct

SEQ ID NO: 128950 - DNA, 562 bp, Homo sapiens
  Payload ID: 5224
  Gene Symbol: EML1
  Gene Name: echinoderm microtubule associated protein like 1
  ENST ID: ENST00000557313
  CDS Start-End: 1-230
atgagctctggggactggccatccatgcctcaaaatctcagttcttgacctgtgggcatgacaagcatgccactctctgggacgctgtgggtcaccgtcccgtctgggacaaaataatagagggtctgtggttgcagtcggaacactcactgggaggtggtttgtgtttgacacagaaacaaaagacttggtcaccgttcacacagatggaaacgaacagctctctgtaatgcgatactcaccagatgggaatttcttagccataggctcacatgacaactgcatctatatatatggcgttagtgacaacgggaggaagtacacgcgagtgggcaagtgctcgggtcattccagcttcattactcacctggactggtctgtaaactcacagttcctcgtgtcaaattccggagactacgaaatcctctactgggttccctctgcctgtaagcaagtcgtaagtgtggaaactacaagagacattgaatgggctacctatacctgcactttgggattccatgtttttggagtgtggccagaaggctcggacggaaccgacatc

SEQ ID NO: 128951 - DNA, 1277 bp, Homo sapiens
  Payload ID: 5224
  Gene Symbol: EML1
  Gene Name: echinoderm microtubule associated protein like 1
  ENST ID: ENST00000554479
  CDS Start-End: 141-1277
ggtggccaggccggccggggcgggacgctgcctggggctggacgcggaggagccccaagccctgctgggtgggtgacagccgctgaggctctgagtgaccctgcaggctggtggccagccggccgcccatcttccacaccatgtcggacggcgagggcccctccgccgatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggggtcaggaaagaaactgctgtgccagcaaccaaaagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaagcaaacccaaggagcctgtattcagtgcagaagaaggctatgtaaaaatgtttcttcgtggacgccctgttaccatgtacatgcccaaagatcaagtggattcttacagcttggaagcaaaagtagaacttccaaccaagagactcaagctggaatgggtctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtgcctagcagttcatcctgatcggatcacgatagcaacaggacaagttgcgggcacatcgaaggatggaaaacaattgcccccacatgtgcgcatctgggattctgtgacattgaatactctccacgtcattggaataggtttttttgaccgagcagtcacctgtattgcattctcaaaatctaatggaggaaccaatctctgtgctgtggatgactccaacgaccatgtgctctctgtatgggactggcagaaagaagaaaaactagcagatgtgaagtgctctaatgaagctgtgtttgctgcggatttccaccccacggacaccaacatcatagttacttgtggaaaa

SEQ ID NO: 128952 - DNA, 568 bp, Homo sapiens
  Payload ID: 5224
  Gene Symbol: EML1
  Gene Name: echinoderm microtubule associated protein like 1
  ENST ID: ENST00000556835
  CDS Start-End: 246-568
gatgttttagctgcgtcgagtcctcaacacgggggacttccagcctggtaccaggatagcctctctggcccagtgtgagcgaaggttcgagctgacttgccagtcccgtgctaagtctcactgaggcagggccttgctgccgcggaaaaacgtgtggacagaggaacgcgccggtcggatgtgggccacagtgagccgcggcgtggaaacggccgaaatatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggggtcaggaaagaaactgctgtgccagcaaccaaaagtaacatcaagaggaccagctcttctgaacgagt

SEQ ID NO: 128953 - DNA, 582 bp, Homo sapiens
  Payload ID: 5224
  Gene Symbol: EML1
  Gene Name: echinoderm microtubule associated protein like 1
  ENST ID: ENST00000554553
  CDS Start-End: 1-366
gtggaggagcaactgcagaggcattacgctggccacaacgatgacgtgaagtgcctagcagttcatcctgatcggatcacgatagcaacaggacaagttgcgggcacatcgaaggatggaaaacaattgcccccacatgtgcgcatctgggattctgtgacattgaatactctccacgtcattggaataggtttttttgaccgagcagtcacctgtattgcattctcaaaatctaatggaggaaccaatctctgtgctgtggatgactccaacgaccatgtgctctctgtatgggactggcagaaagaagaaaaactagcagatgtgaagagatgtgaggcatccgagtccctgtttttcctatagtgctctaatgaagctgtgtttgctgcggatttccaccccacggacaccaacatcatagttacttgtggaaaatcacatctctacttttggacactagaaggaagctcccttaataagaagcaaggattattcgagaaacaagaaaagccaaagtttgtcctctgtgtgactttctctgaaaacggtgacaccattactggagattcaagtggcaac

SEQ ID NO: 128954 - DNA, 539 bp, Homo sapiens
  Payload ID: 5224
  Gene Symbol: EML1
  Gene Name: echinoderm microtubule associated protein like 1
  ENST ID: ENST00000556947
  CDS Start-End: 155-539
aaatgagagtccaggataggtcaagataagaggcagagttttgtcatgttgcctaggctgatatcaaactcctgcgctcaagcagtctgcctacctcagcctcccaaagtgttctctgtgttctctggttggagcacagtaagtgaagggaagaatgatgtacaatgagattggagaggcgaagaagatcacggagaggtttatagaccctgataaggagttggaaattatgattctgaatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggggtcaggaaagaaactgctg

SEQ ID NO: 128955 - DNA, 584 bp, Homo sapiens
  Payload ID: 5224
  Gene Symbol: EML1
  Gene Name: echinoderm microtubule associated protein like 1
  ENST ID: ENST00000556199
  CDS Start-End: 330-584
agaaagcaggagcctggatgggaagaggagcagccaggccgaggtgggcgccgctccccctccccggccctgcccaggtcctcagagagctgggacctgagactcattagtgcctgcataatggatgcctccttctctcttcttggaaatccccagcccatcttgcttaatggccacgagggaagtgggataccggcgctctgctcgtaaagccggcctctgccccccgcatctccccttggaggaggggcggctgggcggcttacacaggggaggcctggtctcttgtcttctgcttcacgacggctggcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggg

SEQ ID NO: 128956 - DNA, 406 bp, Homo sapiens
  Payload ID: 5224
  Gene Symbol: EML1
  Gene Name: echinoderm microtubule associated protein like 1
  ENST ID: ENST00000557741
  CDS Start-End: 1-201
ggggtcaggaaagaaactgctgtgccagcaaccaaaagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaagattaaggaggttaagctggtggaggtgaagcccctcacccaagccctagaacacggatccagctggcctcaaaatctgtgctccttccaccatgttaagctgggaagtattggttggaaatgtctatgaagcagtcgcttttgtcccaaataaagtctccagcaacttctaaacattttgaatagatggttcttaaatgaccctatttctaataaaaagctgcttaaggacaa

SEQ ID NO: 128957 - DNA, 964 bp, Homo sapiens
  Payload ID: 5224
  Gene Symbol: EML1
  Gene Name: echinoderm microtubule associated protein like 1
  ENST ID: ENST00000556714
  CDS Start-End: 110-964
cgcggccgggccggggagcgggcgcggcccggcggcctcagcatggaggacggcttctccagctacagcagcctgtacgacacatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggggtcaggaaagaaactgctgtgccagcaaccaaaagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaagcaaacccaaggagcctgtattcagtgcagaagaaggctatgtaaaaatgtttcttcgtggacgccctgttaccatgtacatgcccaaagatcaagtggattcttacagcttggaagcaaaagtagaacttccaaccaagagactcaagctggaatgggtctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtgcctagcagttcatcctgatcggatcacgatagcaacaggacaagttgcgggcacatcgaaggatggaaaacaattgcccccacatgtgcgcatctgggattctgtgacattgaatactctc

SEQ ID NO: 128958 - DNA, 553 bp, Homo sapiens
  Payload ID: 5224
  Gene Symbol: EML1
  Gene Name: echinoderm microtubule associated protein like 1
  ENST ID: ENST00000555145
  CDS Start-End: 85-553
aagccctgctgggtgggtgacagccgctgaggctctgagtgaccctgcaggctggtggccagccggccgcccatcttccacaccatgtcggacggcgagggcccctccgccgatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggggtcaggaaagaaactgctgtgccagcaaccaaaagattaaacagatctgtgagtcttctcaatgcttgcaaactgaatagatcgacaccaagtaacatcaagaggaccagctcttctgaacgagtgtctcctgggggtcgaagggaaagcaatggggatt

SEQ ID NO: 128959 - DNA, 501 bp, Homo sapiens
  Payload ID: 5224
  Gene Symbol: EML1
  Gene Name: echinoderm microtubule associated protein like 1
  ENST ID: ENST00000553720
  CDS Start-End: 225-501
attctggctgaagtaagggatgagacagcatgcccagaagctgtgtccagcacttggacaggcgccctggtcggcaccctgggaacctcggccgtgcactgccagctttctgggtccatcccagccctgggtgtatggcagatgccttgagatttaacagcccttgagtcaggcctgcaacgtcttatctgcgatttcaacatccagaaagctgtgaaacccagatgttttttgatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctac

SEQ ID NO: 128960 - DNA, 546 bp, Homo sapiens
  Payload ID: 5224
  Gene Symbol: EML1
  Gene Name: echinoderm microtubule associated protein like 1
  ENST ID: ENST00000554386
  CDS Start-End: 1-546
cctagcagttcatcctgatcggatcacgatagcaacaggacaagttgcgggcacatcgaaggatggaaaacaattgcccccacatgtgcgcatctgggattctgtgacattgaatactctccacgtcattggaataggtttttttgaccgagcagtcacctgtattgcattctcaaaatcttgctctaatgaagctgtgtttgctgcggatttccaccccacggacaccaacatcatagttacttgtggaaaatcacatctctacttttggacactagaaggaagctcccttaataagaagcaaggattattcgagaaacaagaaaagccaaagtttgtcctctgtgtgactttctctgaaaacggtgacaccattactggagattcaagtggcaacatcttagtatggggaaaaggtacaaatcgaataagctatgcagttcagggggcccatgagggtggcatttttgcactttgtatgttaagagatggcacactggtgtcgggaggtgggaaagaccgaaagctcatttcttggagcggaaa

SEQ ID NO: 128961 - DNA, 2264 bp, Homo sapiens
  Payload ID: 5225
  Gene Symbol: EML2
  Gene Name: echinoderm microtubule associated protein like 2
  Uniprot ID: O95834
  ENST ID: ENST00000245925
  CDS Start-End: 52-2001
agagccggtcccggctccacccccggccccgaagctccgccacccgccgccatgagtagctttggagctggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 128962 - DNA, 2232 bp, Homo sapiens
  Payload ID: 5225
  Gene Symbol: EML2
  Gene Name: echinoderm microtubule associated protein like 2
  ENST ID: ENST00000399594
  CDS Start-End: 167-1978
atagcagggggacagacagagggggtgggggtggatttggtgttgagttgagggcagagtgtgggactggaaagggacggccagaggactttgcttctaggatacctcccaaatcctctggccctggccctcccatgcattagcaccatcccttctccctagacaaatgggtgtgataccagaaggaccactgtgggtgtcgggctcagatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggtggagtctcgctctgtcacccaggctggagggcaatggcacgatctcggctcactgcaacctccgcctcccgggttcaagtgattcttctgcctcagcctcccgagtagctgggattacaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggac

SEQ ID NO: 128963 - DNA, 2791 bp, Homo sapiens
  Payload ID: 5225
  Gene Symbol: EML2
  Gene Name: echinoderm microtubule associated protein like 2
  Uniprot ID: O95834
  ENST ID: ENST00000536630
  CDS Start-End: 140-2530
actgcggagcccagagggccagctgcgcggcctgtggacgcgggatggcaggggcgagctccacgccctgtccccgtctaagctaccacctttacttccaccaggctgggaaccagggcttccttggttgtggtcagcaatgagtctggatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacact

SEQ ID NO: 128964 - DNA, 543 bp, Homo sapiens
  Payload ID: 5225
  Gene Symbol: EML2
  Gene Name: echinoderm microtubule associated protein like 2
  ENST ID: ENST00000590575
  CDS Start-End: 1-543
tttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtg

SEQ ID NO: 128965 - DNA, 2364 bp, Homo sapiens
  Payload ID: 5225
  Gene Symbol: EML2
  Gene Name: echinoderm microtubule associated protein like 2
  ENST ID: ENST00000589876
  CDS Start-End: 28-2349
ggccccgaagctccgccacccgccgccatgagtagctttggagctggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagttctgggaaagtggcccagcgctgcggaagcggccctttcatcgggcatccgggtgctctttcgacccctcgtggccagtcttggacctgcatggaaaaatgtgccaagaaagttctgctggaaaagtgctggtgattctccacgtgaccctcctccgcgcccccagggtcactctcagccttccttccccagctcggggccctgggagaccgccgtgtgcaaattctatcggcagggtcggtggagagaggtcagggtatttgcttcctgggcccctccctgcatcccgcactcacagtggctgtggttcccctcctctgagccgcagttcctctgggaactcgagctgtccctggagacgggtaacagactccctccctgtcccttctgccctaggctggcgatggcttcgtgcccacttcggatggtcccctggggccgccccatcctttgtggctttctccactctgcccatccctctataaactgcccataaatgctcccagttaaa

SEQ ID NO: 128966 - DNA, 482 bp, Homo sapiens
  Payload ID: 5225
  Gene Symbol: EML2
  Gene Name: echinoderm microtubule associated protein like 2
  ENST ID: ENST00000590043
  CDS Start-End: 150-482
gaagctccgccacccgccgccatgagtagctttggagctgggtgagaccctttcgcagaccaccccccatctcctctccgcgctcccggggcttagatctcagcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaag

SEQ ID NO: 128967 - DNA, 626 bp, Homo sapiens
  Payload ID: 5225
  Gene Symbol: EML2
  Gene Name: echinoderm microtubule associated protein like 2
  ENST ID: ENST00000590819
  CDS Start-End: 1-156
tggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagg

SEQ ID NO: 128968 - DNA, 1952 bp, Homo sapiens
  Payload ID: 5225
  Gene Symbol: EML2
  Gene Name: echinoderm microtubule associated protein like 2
  ENST ID: ENST00000586195
  CDS Start-End: 20-457
agctccgccacccgccgccatgagtagctttggagctggcaaaaccaaagaagttatcttcagtgtggcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 128969 - DNA, 669 bp, Homo sapiens
  Payload ID: 5225
  Gene Symbol: EML2
  Gene Name: echinoderm microtubule associated protein like 2
  ENST ID: ENST00000588496
  CDS Start-End: 1-669
atcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatcttgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccag

SEQ ID NO: 128970 - DNA, 952 bp, Homo sapiens
  Payload ID: 5225
  Gene Symbol: EML2
  Gene Name: echinoderm microtubule associated protein like 2
  ENST ID: ENST00000586770
  CDS Start-End: 278-952
acttcgtgctgtgtgatctttggcgatcactgcctctctgggcctgtgtcttaggctctgcaagatcaaccgagcaaagcacacggcctgcagagaggcagcgctctgccccttactcggccccgttttcatcggagacctccggggagcggtgggggtggaggaatggtttctccccttttctgaactgaatactaagaccctttttttttctttgtcctttcctgacagcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgag

SEQ ID NO: 128971 - DNA, 630 bp, Homo sapiens
  Payload ID: 5225
  Gene Symbol: EML2
  Gene Name: echinoderm microtubule associated protein like 2
  ENST ID: ENST00000586405
  CDS Start-End: 1-230
gcggccgcaaggtcagccgcctgggcaagtgctcgggccattccagttttatcacccacctggattgggcccaggacagcagctgctttgtcaccaactccggggactatgagattctgtacttagagatggggtttcaccatcttggccaggctggtctcgaactcctgacctcaggtgatccagccagatgctgtggctcatgctgcctcctgggattacagacgtgagccaccatgcccggccagatgcgggtttaaaagtagatgctcctgcttacgctgcgggctgtgaagaccccagcatgtgatgccttctcagccagtcctgacaggggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagc

SEQ ID NO: 128972 - DNA, 219 bp, Homo sapiens
  Payload ID: 5225
  Gene Symbol: EML2
  Gene Name: echinoderm microtubule associated protein like 2
  ENST ID: ENST00000587484
  CDS Start-End: 1-219
ccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagggccattccagttttatcacccacctggatt

SEQ ID NO: 128973 - DNA, 361 bp, Homo sapiens
  Payload ID: 5225
  Gene Symbol: EML2
  Gene Name: echinoderm microtubule associated protein like 2
  ENST ID: ENST00000588272
  CDS Start-End: 1-361
gctgtgtgcagtggatgaatccaatgatcacatgctctcggtgtgggactgggccaaggagaccaaggtggtggatgtcaaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggc

SEQ ID NO: 128974 - DNA, 553 bp, Homo sapiens
  Payload ID: 5225
  Gene Symbol: EML2
  Gene Name: echinoderm microtubule associated protein like 2
  ENST ID: ENST00000593255
  CDS Start-End: 155-553
acatttcaactctgctcaaacatagcaaacacaaatacagcgttgtgtatactccaggcacttcccaataattaaccaatttcaccctcgcaactacccccgggaggtcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttg

SEQ ID NO: 128975 - DNA, 2763 bp, Homo sapiens
  Payload ID: 5225
  Gene Symbol: EML2
  Gene Name: echinoderm microtubule associated protein like 2
  Uniprot ID: O95834
  ENST ID: ENST00000587152
  CDS Start-End: 186-2738
atactccggttgtgggcgggaccagacggtacctagggggatccgggcgcagccaatcctggccctaggattgtgttggggggcttggcaggcggtgtcccgacccccctttctgggcatcctggggatgaccccagcgccgggcccggcgccggccgcctgatgccaggcgagctgagctggggatgctggaacgaagggcgttgctatggcaacgggaggcagggcctggttggggggaccgggcccgggctgggaccgggggggccggcggtggctgtggtggggcgatggcggagcgcggcccggccttctgcggcctgtacgacacgtcctcgctgctgcgatactgcaacgatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtc

SEQ ID NO: 128976 - DNA, 2062 bp, Homo sapiens
  Payload ID: 5225
  Gene Symbol: EML2
  Gene Name: echinoderm microtubule associated protein like 2
  ENST ID: ENST00000588308
  CDS Start-End: 16-1299
ccgccacccgccgccatgagtagctttggagctggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgagatggctgctgctggacacggagacccatgacctggtggctatccacacagacggcaatgaacagatctcagtggtcagcttctccccagggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaa

SEQ ID NO: 128977 - DNA, 551 bp, Homo sapiens
  Payload ID: 5225
  Gene Symbol: EML2
  Gene Name: echinoderm microtubule associated protein like 2
  ENST ID: ENST00000590018
  CDS Start-End: 257-551
caaaaccaaagaagttatcttcagtgtgggtgagtggggagatggggaagggctcggtggaagcttgcttgttggggtgacaggctggagccagaggtcaggagtcttggctactgggtctttgcctctctggcctcagtttccctgcctttaaaaaaataaataaataaagctggaagaggagagggaatagggatggggctggtgtcagtgcctgacctctgggggtgtcctggcagaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcg

SEQ ID NO: 128978 - DNA, 539 bp, Homo sapiens
  Payload ID: 5225
  Gene Symbol: EML2
  Gene Name: echinoderm microtubule associated protein like 2
  ENST ID: ENST00000592853
  CDS Start-End: 1-276
ccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaaggctggagtgcaatggcataatcttggctcactgcaacctccacctcccaggttccagcgattctcctgactcagcctcctgagtagctgagactacagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaa

SEQ ID NO: 128979 - DNA, 526 bp, Homo sapiens
  Payload ID: 5225
  Gene Symbol: EML2
  Gene Name: echinoderm microtubule associated protein like 2
  ENST ID: ENST00000591721
  CDS Start-End: 83-526
taaactctccccgtttctccctctgcttgacgtttgcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatct

SEQ ID NO: 128980 - DNA, 542 bp, Homo sapiens
  Payload ID: 5225
  Gene Symbol: EML2
  Gene Name: echinoderm microtubule associated protein like 2
  ENST ID: ENST00000588172
  CDS Start-End: 118-542
ggagtgtgcggatgggttggagagctgtggggatttccttcccccttcagagtcctcttccttggctcatgtccaagtgtcccagccccagatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaagg

SEQ ID NO: 128981 - DNA, 3017 bp, Homo sapiens
  Payload ID: 5226
  Gene Symbol: EML3
  Gene Name: echinoderm microtubule associated protein like 3
  ENST ID: ENST00000278845
  CDS Start-End: 68-2761
ccggccgtggcccccgcggcttagacgcctcctccgccgccgccgctcggagcaacccgggggccggatggacggggccgcggggcccggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagcagtcttgcagcccccccaggactgccacccacgtgcaccccttccttggtgagccgaggcacccagacggagacagaggtggagctcaagtcatcccctggaccccctggcctgagcaatggacccccagcccctcagggggccagcgaagagcctagcgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcg

SEQ ID NO: 128982 - DNA, 3256 bp, Homo sapiens
  Payload ID: 5226
  Gene Symbol: EML3
  Gene Name: echinoderm microtubule associated protein like 3
  Uniprot ID: Q32P44
  ENST ID: ENST00000394773
  CDS Start-End: 309-2999
ggctccgcgtccggcgcctgtttgtgctgcggcgctgtggcaccggacggccctgccaccccacccccgggagccgagagcggccccgggagagtccgagggcccgggggggtctggagactgcggccccgggcccacagcgccccctccaggccccttccccgcgcccgacagcgccccctcggggtggtggtacggcgcccttcgcgcgcgccccggggtgcttccccttcccctctccccggccgtggcccccgcggcttagacgcctcctccgccgccgccgctcggagcaacccgggggccggatggacggggccgcggggcccggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagtcttgcagcccccccaggactgccacccacgtgcaccccttccttggtgagccgaggcacccagacggagacagaggtggagctcaagtcatcccctggaccccctggcctgagcaatggacccccagcccctcagggggccagcgaagagcctagcgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgc

SEQ ID NO: 128983 - DNA, 2818 bp, Homo sapiens
  Payload ID: 5226
  Gene Symbol: EML3
  Gene Name: echinoderm microtubule associated protein like 3
  ENST ID: ENST00000394776
  CDS Start-End: 1-2735
gtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagcagtcttgcagcccccccaggactgccacccacgtgcaccccttccttggtgagccgaggcacccagacggagacagaggtggagctcaagtcatcccctggaccccctggcctgagcaatggacccccagcccctcagggggccagcgaagagcctagcgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacgtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcg

SEQ ID NO: 128984 - DNA, 671 bp, Homo sapiens
  Payload ID: 5226
  Gene Symbol: EML3
  Gene Name: echinoderm microtubule associated protein like 3
  ENST ID: ENST00000439994
  CDS Start-End: 1-414
attctttactgggacgtggctggaggctgcaagcagctgaagaatcgctatgagagccgagaccgggaatgggctacctacacctgtgtgctgggctttcacgtctacgtacccgtgcgctcgtgccaaggtgaggccgcggggatcgccggggtgggaccggtgggcccgagggctcagccgccaccgcaactcttccctccggcccaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgc

SEQ ID NO: 128985 - DNA, 578 bp, Homo sapiens
  Payload ID: 5226
  Gene Symbol: EML3
  Gene Name: echinoderm microtubule associated protein like 3
  ENST ID: ENST00000419857
  CDS Start-End: 239-578
gtttgtgctgcggcgctgtggcaccggacggccctgccaccccacccccgggagccgagagcggccccgggagagtccgagggcccgggggggtctggagactgcggccccgggcccacagcgccccctccaggccccttccccgcgcccgacagcgccccctcggggtggtggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagtcttgcagcccccccaggactgccacccacgtgcaccccttccttggtgagccgaggcacccagacggagacagaggtggagctcaagtcatcccctggaccccctggcctgagcaatggacccccagcccctcagggggccagcgaagagcctagcgggacccaatctgaaggagggggcagcagcagcagtggtgctggctcccctggccccccggggatcctcaggccct

SEQ ID NO: 128986 - DNA, 3665 bp, Homo sapiens
  Payload ID: 5226
  Gene Symbol: EML3
  Gene Name: echinoderm microtubule associated protein like 3
  Uniprot ID: Q32P44
  ENST ID: ENST00000494448
  CDS Start-End: 851-1435
gggttatgccagagctggacggctgtctggaggcgtccccgcgtgctcctccgccccaggggctccgagcatcctccacagttcctccggtcgccctccctagttgcttgggtcttgctgtcacttcgggcttccccagcgtcattctacgccccacgtaactccgggcccctcgatgtttccctgccccctgcgttactccgggcctcttctcgtggtatttcaggtctttttccttctgatccccactgccccctgagaccttcactgtgactctgctcaccactcacactctctcctgtcactctggatctcttttcttgtactctgggtcctcagtatgactccattcccgcaccccgttctctctcctggtgttcccccggctcagttactcagctttcgctggagacctgagcttgctgggggcgcgtggggagggctgcggtccctgccctcaccagtgcggcgcctctctctgtggctcccacgttcctcggcagtactccatatttcccccccggtactccatggtactcccagtctttgcggaggctgagacggcagcaggaagggagctttgccaggtttctcgcctgccctgccagaaggaggcccttgatcctttaccaccgtctcctcccctctggacgagcattcaagcctggggctgcctgaaaggggcagtcctaccggacacatgtaaagttgtggggagacagaatcccctctacgctttcttcaggtgatgggtacattctgagtacctcttgcccttttcccaggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagtcttgcagcccccccaggactgccacccacgtgcaccccttccttggtgagccgaggcacccagacggagacagaggtggagctcaagtcatcccctggaccccctggcctgagcaatggacccccagcccctcagggggccagcgaagagcctagcgggacccaatctgaaggagggggcagcagcagcagtggtgctggctcccctggccccccggggatcctcaggcccttgcagcccccacagcgtgctgacacagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaacc

SEQ ID NO: 128987 - DNA, 2509 bp, Homo sapiens
  Payload ID: 5226
  Gene Symbol: EML3
  Gene Name: echinoderm microtubule associated protein like 3
  ENST ID: ENST00000531557
  CDS Start-End: 215-2254
ctatgcccccaccaggccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtc

SEQ ID NO: 128988 - DNA, 599 bp, Homo sapiens
  Payload ID: 5226
  Gene Symbol: EML3
  Gene Name: echinoderm microtubule associated protein like 3
  ENST ID: ENST00000466886
  CDS Start-End: 218-599
atgccagagctggacggctgtctggaggcgtccccgcgtgctcctccgccccaggggctccgagcatcctccacagttcctccggtcgccctccctagttgcttgggtcttgctgtcacttcgggcttccccagcgtcattctacgccccacgtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagtcttgcagcccccccaggactgccacccacgtgcaccccttccttggtgagccgaggcacccagacggagacagaggtggagctcaagtcatcccctggaccccctggcctgagcaatggacccccagcccctcagggggccagcgaagagcctagcgggacccaatctgaaggagggggcagcagcagcagtggtgctggctcccctggccccccggggatcctcaggcccttgcagcccccacagcgtgctgacacgccgcgaagaaattctt

SEQ ID NO: 128989 - DNA, 2909 bp, Homo sapiens
  Payload ID: 5226
  Gene Symbol: EML3
  Gene Name: echinoderm microtubule associated protein like 3
  Uniprot ID: Q32P44
  ENST ID: ENST00000529309
  CDS Start-End: 74-2827
ctctccccggccgtggcccccgcggcttagacgcctcctccgccgccgccgctcggagcaacccgggggccggatggacggggccgcggggcccggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagtcttgcagcccccccaggactgccacccacgtgcaccccttccttggtgagccgaggcacccagacggagacagaggtggagctcaagtcatcccctggaccccctggcctgagcaatggacccccagcccctcagggggccagcgaagagcctagcgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacgtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtc

SEQ ID NO: 128990 - DNA, 2901 bp, Homo sapiens
  Payload ID: 5226
  Gene Symbol: EML3
  Gene Name: echinoderm microtubule associated protein like 3
  ENST ID: ENST00000494176
  CDS Start-End: 150-2819
tgtaaagttgtggggagacagaatcccctctacgctttcttcaggtgatgggtacattctgagtacctcttgcccttttcccaggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagcagtcttgcagcccccccaggactgccacccacgtgcaccccttccttggtgagccgaggcacccagacggagacagaggtggagctcaagtcatcccctggaccccctggcctgagcaatggacccccagcccctcagggggccagcgaagagcctagcgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacgtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtc

SEQ ID NO: 128991 - DNA, 565 bp, Homo sapiens
  Payload ID: 5226
  Gene Symbol: EML3
  Gene Name: echinoderm microtubule associated protein like 3
  ENST ID: ENST00000466671
  CDS Start-End: 182-565
agttgcttgggtcttgctgtcacttcgggcttccccagcgtcattctacgccccacgtaactccgggcccctcgatgtttccctgccccctgcgttactccgggcctcttctcgtggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagcagtcttgcagcccccccaggactgccacccacgtgcaccccttccttggtgagccgaggcacccagacggagacagaggtggagctcaagtcatcccctggaccccctggcctgagcaatggacccccagcccctcagggggccagcgaagagcctagcgggacccaatctgaaggagggggcagcagcagcagtggtgctggctcccctggccccccggggatcctcaggcccttgcagcccccacagcgtgctgacacgccgcgaagaaattct

SEQ ID NO: 128992 - DNA, 5549 bp, Homo sapiens
  Payload ID: 5227
  Gene Symbol: EML4
  Gene Name: echinoderm microtubule associated protein like 4
  Uniprot ID: Q9HC35
  ENST ID: ENST00000318522
  CDS Start-End: 263-3208
ggcgcggcgctcgcggctgctgcctgggagggaggccgggcaggcggctgagcggcgcggctctcaacgtgacggggaagtggttcgggcggccgcggcttactaccccagggcgaacggacggacgacggaggcgggagccggtagccgagccgggcgacctagagaacgagcgggtcaggctcagcgtcggccactctgtcggtccgctgaatgaagtgcccgcccctctaagcccggagcccggcgctttccccgcaagatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccgggaaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtattattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaactctgttttatcctagaactaagagagcattggtttgttaaagagctttcaatgtatattaaaaccttcaatactcagaaatgatggattcctccaaggagtcctttactagcctaaacattctcaaatgtttgagattcaagtgaatggaaggaaaaccacatgcctttaaaactaaactgtaataattacctggctaatttcagctaagccttcatcataatttgttccctcagtaataggagaaatataaatacagtaagtttagattattgaattggtgcttgaaatttattggttttgttgtaattttatacagattatatgagggataagatactcatcaaattgcaaattcttttttttacagaagtgtgggtaacagtcacagcagttttttttaccaacagcatacttaacagacttgctgtgtagcagtttttttctggtggagttgctgtaagtcttgtaagtctaatgtggctatcctactcttttgggcaatgcatgtattatgcattggaaaggtattttttttaagttctgttggctagctatggttttcagtacatttcctactttaagagtaattactgacaaatatgtatttcctatatgtttatactttgattataaaaaagtattttgttttgattttttaacttgctgcattgttttgatactttctatttttttggtcaaatcatgtttagaaactttggatgagttaagaagtcttaagtatgcaggcgtttacgtgattgtgccattccaaagtgcatcagaactgtcattcccttctaatatcttctcaggagtaatacaaatcaggtatttcatcatcatttggtaatatgaaaactccagtgaactcccaaggacatttacaacatttatattcacacgctgtatggaagggtgtgggtgtgtgtgaaggggcgagtggagacactgtgtgtatctctagataagaagatatgcaccacgttgaaaatactcagtgtagatctctatgtgtataggtatctgtatatctttccttttgtttacaactgttaaaaaacctcaaaatagttctcttcaaaagaagagagattccaagcaacccatctttcttcagtatgtatgttctgtacatacttatcggagcgcgccagtaagtatcaggcatatatatctgtctgttagcaatgattattacatcatcagatcagcatgtgctatactccctgcaagaaatatactgacatgaacaggcagttcttggagaagaaagagcatttctttaagtacctggggaatacagctctcagtgatcagcagggagtttatttgaggacatcagtcacctttggggttgccatgtacaatgagatttataatcatgatactcttcggtggtagtttcaaaagacactactaatacgcaggaagcgttccagctatttaatgctggcaactactgtttaatggtcagttaaatctgtgataatggttggaagtgggtggggttatgaaattgtagatgtttttagaaaaacttgtgaatgaaaatgaatccaagtgtttcatgtgaagatgttgagccattgctatcatgcattcctgtctcatggcagaaaattttgaagattaaaaaataaaataatcaaaatgtttcctctttctaa

SEQ ID NO: 128993 - DNA, 3797 bp, Homo sapiens
  Payload ID: 5227
  Gene Symbol: EML4
  Gene Name: echinoderm microtubule associated protein like 4
  ENST ID: ENST00000401738
  CDS Start-End: 152-3130
ggcgaacggacggacgacggaggcgggagccggtagccgagccgggcgacctagagaacgagcgggtcaggctcagcgtcggccactctgtcggtccgctgaatgaagtgcccgcccctctaagcccggagcccggcgctttccccgcaagatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagcaaaaatgtcaactcgcgaaaaaaacagccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccgggaaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtattattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgt

SEQ ID NO: 128994 - DNA, 3568 bp, Homo sapiens
  Payload ID: 5227
  Gene Symbol: EML4
  Gene Name: echinoderm microtubule associated protein like 4
  Uniprot ID: Q9HC35
  ENST ID: ENST00000402711
  CDS Start-End: 260-3031
gcggcgctcgcggctgctgcctgggagggaggccgggcaggcggctgagcggcgcggctctcaacgtgacggggaagtggttcgggcggccgcggcttactaccccagggcgaacggacggacgacggaggcgggagccggtagccgagccgggcgacctagagaacgagcgggtcaggctcagcgtcggccactctgtcggtccgctgaatgaagtgcccgcccctctaagcccggagcccggcgctttccccgcaagatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccgggaaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtattattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaa

SEQ ID NO: 128995 - DNA, 5910 bp, Homo sapiens
  Payload ID: 5228
  Gene Symbol: EML5
  Gene Name: echinoderm microtubule associated protein like 5
  Uniprot ID: Q05BV3
  ENST ID: ENST00000380664
  CDS Start-End: 1-5910
atggcggcccggagcgccccgagctgccacctgcggctcgagtgggtgtacggctaccggggccaccagtgccgcaacaacctctactacactgcggccaaggagatcgtatacttcgtggcgggggtcggcgtggtgtacagcccgcgggagcacaggcagaagttctaccggggccacagcgacgacatcatcagccttgcattgcatcctgaacgagtgttggtagcaacaggacaagttgggaaagagccttatatttgtatttgggattcatacactgtgcagaccatatcagttttaaaggatgttcatacacatggtatagcttgcttggcgtttgacttagatggacagcgcttggtttcagttggacttgattcaaagaatgcagtttgtgtttgggactggaaaaggggaaaaatgttgtctatggctcctggtcatacagatagaatatttgatatttcttgggatttgtaccagccaaataaacttgtcagctgtggtgtaaaacatatcaagttctggagtttatgtggaaatgctctgaccccaaaacgaggtgtctttggtaagacgggtgaccttcagacaatactgtgcctagcctgtgcaagggatgaattaacatattctggtgcactcaatggggatatatatgtttggaaaggaatcaatcttatacgaacaatacaaggagcccatgctgcaggaatttttagcatgaatgcttgtgaagaaggctttgctactggtggcagagatggttgtattcgtctttgggatttaacttttaaaccaattactgtgattgatctcagggaaacagaccagggatacaaaggtttgtctgtaaggagtgtgtgttggcgaggtgaccacattctagttggaacacaggacagtgaaatttttgaaattgtggtgcaagaaagaaataaaccttttctaattatgcaagggcattgtgaaggtgaactttgggcacttgctgtccatcctactaaacctttggctgtgactggaagtgatgatcgttcggtcaggatatggagcctagtagatcatgcattaatagcaaggtgtaatatggaagaaccaattcgttgtgcagctgtcaatgcagatggaatccatcttgcccttggaatgaaggatggctcattcactgtacttagagtaagagatatgacggaagttgtacatattaaagataggaaggaggcaattcatgagttaaaatattcaccagatggaacttaccttgctgttggatgcaatgacagctcggttgatatttatggagttgctcagcgttataaaaaagttggcgagtgtttgggatcccttagtttcatcactcatctggactggtcttcagacagtagatatttgcagacaaatgatggaaatgggaaaagacttttttatagaatgccaggaggaaaggaagtgacaagtacagaagaaataaaaggtgttcattgggcttcatggacatgtgtttcaggccttgaagtaaatggaatttggcccaagtattcagatatcaacgatataaattcagtagatggaaattatattggccaagttttagttacagctgatgactatggaattataaaattattccgatatccatgtttaagaaaaggggccaagtttagaaaatatattggccattcagctcacgtaactaatgtcagatggtcacatgattatcagtgggttatttctattggtggagcagatcactctgtctttcagtggaaatttattcctgaaagaaaactgaaagatgctgttcacatagcaccccaagaaagtctggctgactctcatagtgatgaatcagattcagatctgtctgatgttccagaactggattctgaaattgaacaagagacacagctcacctaccgtcgacaggtttacaaagaagatctacctcagcttaaagaacagtgcaaagagaaacaaaaaagtgctacttctaaaagaagagagcgggctccaggaaatagtattcgattacactttgttcacggttacagaggttatgactgtcgaagtaatctgttttatactcaaattggtgaaattgtgtaccatgtggcagcagtgggtgtcatttataatcgacagcaaaacacacagcgtttttatctgggtcatgatgatgatattctctgcctaactattcatcctttgaaagactacgtggcaacaggccaggttggtagagatccctcaattcatatatgggatacagagaccattaaaccattgtccatattaaagggccaccaccagtatggtgttagtgccgttgatttctcagcggatgggaaacgtttggcatcagttggcatagatgatagccatactgttgtgctctgggactggaagaaaggagagaaactttcaatagcaagaggaagtaaagataagatttttgttgtaaagatgaacccctatgtgcctgataaactaattacagctggaattaaacacatgaaattttggcgtaaagcagggggaggattgattggaagaaaaggctacataggcacactggggaaaaatgacacaatgatgtgtgcagtgtatggatggactgaagagatggctttttctggaacatccacaggagatgtgtgtatctggagagacatctttcttgtaaaaacagtgaaagcgcatgatgggccagtgttcagtatgcatgcattggaaaaagggtttgtaactggaggaaaagatggtatagtagctctttgggatgactcttttgaaagatgtctcaagacctatgctataaaaagagctgcattggccccaggatctaaaggtcttctcttggaagataatccatctatacgtgccatatcattaggacatggtcatattttagttggcacaaagaatggtgaaatactagaagtggataaaagtggcccaataacacttctggttcagggacacatggaaggagaggtgtggggtttagctacacacccttatctgcccatctgtgctactgtaagcgatgataaaaccttaagaatatgggatctctcacctagtcattgtatgttggctgtccggaagctgaaaaagggtgggaggtgttgctgtttttctcctgatggtaaagctttagccgtaggtctcaacgatggaagcttcttaatggcaaatgcggatactctagaggatcttgtgtcttttcatcacagaaaagatatgatttcagatattcgattttcacctggttctgggaaatatcttgctgtagcatcccatgacagctttatagatatatacaatgtaatgagtagtaaacgagtaggaatatgcaaaggagctaccagttacataacccatattgattgggatattagaggaaagcttttacaggtcaacactggtgctaaggaacaattattctttgaagctcccagagggaaaaaacaaaccatccccagcgtggaggtagaaaaaattgcttgggcatcatggacaagtgtacttggtttatgctgtgaaggaatttggccagtaattggagaagttacagatgtaactgcttcttgcctcaccagtgacaaaatggttctagctaccggggacgatttgggatttgtgaagttatttagatatcctactaaagggaaatttggaaagtttaagaggtatgtggcccatagtacacatgtcacaaatgttcgctggacttatgatgacagcatgttggttaccctaggcggtacagatatgtctttaatggtgtggacaaatgagatggaaggctatcgagaaaaaaggccttgtgatagtgaagaatccgacattgattctgaagaagatgggggctatgacagtgatgttacaagggagaatgaaatcagttacaccatcagagccttatcaacaaatattcgcccaatgttaggaatcaagcctcatttacaacaaaaagaaccctcaattgatgaaaggcctccagtgagcagggccccaccacagccagagaaactccagacaaacaatgtaggcaagaaaaagagacctatagaggaccttgtgttggagctcatttttggttatcgaggcagagactgtaggaataatgttcactatttaaatgatggtgatgatataatttatcacactgcatctgttggaattctgcacaatgttgctacaggttctcagagtttttatcaggaacataatgatgatattctgtgcctcacagtaaaccagcaccccaaatttatcaacatagtggcaactggccaagtaggtgattcagcagacatgtcagctacagctccttctattcacatctgggatgcaatgaacaagcagactttatctatcctaagatgctaccattcaaagggagtatgttcagtcagcttcagtgctactggcaaactattgctgtctgtgggactagacccagaacatactattaccatttggagatggcaggaaggtgccaaaattgccagcagagctggtcacaatcaacgtatttttgtggcagaattccgaccagattcagatacccagtttgtctcagtgggagtaaaacatgtgaagttctggaccctggcaggaagagctcttcttagcaaaaaagggctactgagcacactggaagatgcccggatgcagaccatgctcgctattgcatttggtgcaaataacttgacgtttacaggtaccatcagtggtgatgtctgtgtgtggaaagatcacatattgtgtagaatcgtggcgagagctcacaacgggcctgtgtttgccatgtacaccaccctgcgagatggacttatcgtgactgggggaaaggaaaggccgtcaaaagaaggaggagcggttaaactgtgggatcaggaactgaggcggtgccgtgccttcaggcttgagacaggacaagccacagattgtgttcgttctgtgtgcagaggcaaaggcaagatccttgttgggacaaggaatgctgaaataatcgaagttggagagaaaaatgcagcttgtaatattttagttaacggtcatgtggatgggccaatctggggactagcaacacatccttccagggattttttcctttctgctgcagaagatgggacagtgagactttgggatattgctgataaaaagatgttaaacaaagtgaatttgggacatgctgctcgtactgtgtgttacagccctgaaggggacatggtggctattggaatgaaaaatggagaatttatcattttactagtgagttctctaaaaatatggggaaagaagagagacaggagatgtgcaatccatgatatcagatttagtccggattcccggtatctggcagtaggttctagtgagaactcagtggatttttatgacctaacgctgggccccactcttaacagaatcagctactgcaaagacattccaagctttgtcattcaaatggacttctctgcagatagcagttatctccaggtctctagtggctgctataaacggcatgtctatgaagtgccttcaggaaaacatcttatggatcatgccgctattgacagaattacttgggctacatggactagtattctaggagatgaggttttgggaatctggtccagacatgctgagaaagctgatgtcaactgtgcctgtgtatctcattcaggaatcagtcttgttacaggagatgactttggcatggttaagttatttgacttcccatgtccagaaaaatttgcaaaacacaaaaggttcttgggtcattcgccccatgtgacaaatattcgatttaccagtggtgatcgacatgttgttagtgctggaggtgatgactgcagcttatttgtctggaaatgtgtacatacacctcactga

SEQ ID NO: 128996 - DNA, 3600 bp, Homo sapiens
  Payload ID: 5228
  Gene Symbol: EML5
  Gene Name: echinoderm microtubule associated protein like 5
  ENST ID: ENST00000553526
  CDS Start-End: 1-183
atttcagatattcgattttcacctggttctgggaaatatcttgctgtagcatcccatgacagctttatagatatatacaatgtaatgagtagtaaacgagtaggaatatgcaaaggagctaccagttacataacccatattgattgggatattagagcttttacaggtcaacactggtgctaaggaacaattattctttgaagctcccagagggaaaaaacaaaccatccccagcgtggaggtagaaaaaattgcttgggcatcatggacaagtgtacttggtttatgctgtgaaggaatttggccagtaattggagaagttacagatgtaactgcttcttgcctcaccagtgacaaaatggttctagctaccggggacgatttgggatttgtgaagttatttagatatcctactaaagggaaatttggaaagtttaagaggtatgtggcccatagtacacatgtcacaaatgttcgctggacttatgatgacagcatgttggttaccctaggcggtacagatatgtctttaatggtgtggacaaatgagatggaaggctatcgagaaaaaaggccttgtgatagtgaagaatccgacattgattctgaagaagatgggggctatgacagtgatgttacaagggagaatgaaatcagttacaccatcagagccttatcaacaaatattcgcccaatgttaggaatcaagcctcatttacaacaaaaagaaccctcaattgatgaaaggcctccagtgagcagggccccaccacagccagagaaactccagacaaacaatgtaggcaagaaaaagagacctatagaggaccttgtgttggagctcatttttggttatcgaggcagagactgtaggaataatgttcactatttaaatgatggtgatgatataatttatcacactgcatctgttggaattctgcacaatgttgctacaggttctcagagtttttatcaggaacataatgatgatattctgtgcctcacagtaaaccagcaccccaaatttatcaacatagtggcaactggccaagtaggtgattcagcagacatgtcagctacagctccttctattcacatctgggatgcaatgaacaagcagactttatctatcctaagatgctaccattcaaagggagtatgttcagtcagcttcagtgctactggcaaactattgctgtctgtgggactagacccagaacatactattaccatttggagatggcaggaaggtgccaaaattgccagcagagctggtcacaatcaacgtatttttgtggcagaattccgaccagattcagatacccagtttgtctcagtgggagtaaaacatgtgaagttctggaccctggcaggaagagctcttcttagcaaaaaagggctactgagcacactggaagatgcccggatgcagaccatgctcgctattgcatttggtgcaaataacttgacgtttacaggtaccatcagtggtgatgtctgtgtgtggaaagatcacatattgtgtagaatcgtggcgagagctcacaacgggcctgtgtttgccatgtacaccaccctgcgagatggacttatcgtgactgggggaaaggaaaggccgtcaaaagaaggaggagcggttaaactgtgggatcaggaactgaggcggtgccgtgccttcaggcttgagacaggacaagccacagattgtgttcgttctgtgtgcagaggcaaaggcaagatccttgttgggacaaggaatgctgaaataatcgaagttggagagaaaaatgcagcttgtaatattttagttaacggtcatgtggatgggccaatctggggactagcaacacatccttccagggattttttcctttctgctgcagaagatgggacagtgagactttgggatattgctgataaaaagatgttaaacaaagtgaatttgggacatgctgctcgtactgtgtgttacagccctgaaggggacatggtggctattggaatgaaaaatggagaatttatcattttactagtgagttctctaaaaatatggggaaagaagagagacaggagatgtgcaatccatgatatcagatttagtccggattcccggtatctggcagtaggttctagtgagaactcagtggatttttatgacctaacgctgggccccactcttaacagaatcagctactgcaaagacattccaagctttgtcattcaaatggacttctctgcagatagcagttatctccaggtctctagtggctgctataaacggcatgtctatgaagtgccttcaggaaaacatcttatggatcatgccgctattgacagaattacttgggctacatggactagtattctaggagatgaggttttgggaatctggtccagacatgctgagaaagctgatgtcaactgtgcctgtgtatctcattcaggaatcagtcttgttacaggagatgactttggcatggttaagttatttgacttcccatgtccagaaaaatttgcaaaacacaaaaggttcttgggtcattcgccccatgtgacaaatattcgatttaccagtggtgatcgacatgttgttagtgctggaggtgatgactgcagcttatttgtctggaaatgtgtacatacacctcactgagagatgctgagatgactacagaaattaactttgagaccagaattacagagaagaaaaaccaaaacccaaccctgcatggtcaagtggtgctaacccaagactgtaacagggagaaatgcccagaatcatcaaaatagtgaaagactgatctgttcaaaatatttgctatatgcactgggtataatccgtaatccatacactgccagataatgccatttcaaggaaggatcgaatacttgatggtaaaggccaagtccccctgtattgggaagtgtgtgatttcggcagacctgctgggaaaatttagggtagagcactctttacagaagaactcaaaaacccaatttggataattttcattatctttttagcaaaatggtttcttaatgtttatattttattttcaaggttcattgtttaatgaaatattttattcttgcatttccataaggaaagggaaagtcatgatcatcctaaaggatcacagtttttaaaaggcaaacattttccctaaggaaacagacacaagctttcctagagaatatgatgttttttaggcattaataaggtccttttttataaaggacacttttctcctagtagttttgaattcaggaacagatccaaagttagcagtatatggctgctacatttccattttcattttcgagccatcagtttatgttcagatgccatctctgtaatcgcacatttaaaacataactgtagcctcactaatggaaaagtagtatgatgaacaatcattcccaatggtgtacaatgtaagggttttagggagcaacagtatttaactggaagaaagaattgcatatttaatgtagtctaatatatacacatttgtttaacatgtaaacaaaagtgttaaattcacatatacaacattatacaatttaatcactcttggaataaaatttttatagcctttt

SEQ ID NO: 128997 - DNA, 9570 bp, Homo sapiens
  Payload ID: 5228
  Gene Symbol: EML5
  Gene Name: echinoderm microtubule associated protein like 5
  Uniprot ID: Q05BV3
  ENST ID: ENST00000554922
  CDS Start-End: 250-6183
ctgggcatccacttgacagccggcggcgctcgcggccctcagcatgttccgcgaggcgagggttttcctcccgcctgtgggctgaggcggcggcggcccccgaaacgagatgcacctgacgggcgcggcttagaggacgcggctggcgggaagtcccggcagccagcgggagggctttcgttgccgggccgccgccgcctcccgtcgccgccgcgggcccgagcgggagcggcgggtgggcgccccgacatggcggcccggagcgccccgagctgccacctgcggctcgagtgggtgtacggctaccggggccaccagtgccgcaacaacctctactacactgcggccaaggagatcgtatacttcgtggcgggggtcggcgtggtgtacagcccgcgggagcacaggcagaagttctaccggggccacagcgacgacatcatcagccttgcattgcatcctgaacgagtgttggtagcaacaggacaagttgggaaagagccttatatttgtatttgggattcatacactgtgcagaccatatcagttttaaaggatgttcatacacatggtatagcttgcttggcgtttgacttagatggacagcgcttggtttcagttggacttgattcaaagaatgcagtttgtgtttgggactggaaaaggggaaaaatgttgtctatggctcctggtcatacagatagaatatttgatatttcttgggatttgtaccagccaaataaacttgtcagctgtggtgtaaaacatatcaagttctggagtttatgtggaaatgctctgaccccaaaacgaggtgtctttggtaagacgggtgaccttcagacaatactgtgcctagcctgtgcaagggatgaattaacatattctggtgcactcaatggggatatatatgtttggaaaggaatcaatcttatacgaacaatacaaggagcccatgctgcaggaatttttagcatgaatgcttgtgaagaaggctttgctactggtggcagagatggttgtattcgtctttgggatttaacttttaaaccaattactgtgattgatctcagggaaacagaccagggatacaaaggtttgtctgtaaggagtgtgtgttggcgaggtgaccacattctagttggaacacaggacagtgaaatttttgaaattgtggtgcaagaaagaaataaaccttttctaattatgcaagggcattgtgaaggtgaactttgggcacttgctgtccatcctactaaacctttggctgtgactggaagtgatgatcgttcggtcaggatatggagcctagtagatcatgcattaatagcaaggtgtaatatggaagaaccaattcgttgtgcagctgtcaatgcagatggaatccatcttgcccttggaatgaaggatggctcattcactgtacttagagtaagagatatgacggaagttgtacatattaaagataggaaggaggcaattcatgagttaaaatattcaccagatggaacttaccttgctgttggatgcaatgacagctcggttgatatttatggagttgctcagcgttataaaaaagttggcgagtgtttgggatcccttagtttcatcactcatctggactggtcttcagacagtagatatttgcagacaaatgatggaaatgggaaaagacttttttatagaatgccaggaggaaaggaagtgacaagtacagaagaaataaaaggtgttcattgggcttcatggacatgtgtttcaggccttgaagtaaatggaatttggcccaagtattcagatatcaacgatataaattcagtagatggaaattatattggccaagttttagttacagctgatgactatggaattataaaattattccgatatccatgtttaagaaaaggggccaagtttagaaaatatattggccattcagctcacgtaactaatgtcagatggtcacatgattatcagtgggttatttctattggtggagcagatcactctgtctttcagtggaaatttattcctgaaagaaaactgaaagatgctgttcacatagcaccccaagaaagtctggctgactctcatagtgatgaatcagattcagatctgtctgatgttccagaactggattctgaaattgaacaagagacacagctcacctaccgtcgacaggtttacaaagaagatctacctcagcttaaagaacagtgcaaagagaaacaaaaaagtgctacttctaaaagaagagagcgggctccaggaaatagtattcgattacactttgttcacggttacagaggttatgactgtcgaagtaatctgttttatactcaaattggtgaaattgtgtaccatgtggcagcagtgggtgtcatttataatcgacagcaaaacacacagcgtttttatctgggtcatgatgatgatattctctgcctaactattcatcctttgaaagactacgtggcaacaggccaggttggtagagatccctcaattcatatatgggatacagagaccattaaaccattgtccatattaaagggccaccaccagtatggtgttagtgccgttgatttctcagcggatgggaaacgtttggcatcagttggcatagatgatagccatactgttgtgctctgggactggaagaaaggagagaaactttcaatagcaagaggaagtaaagataagatttttgttgtaaagatgaacccctatgtgcctgataaactaattacagctggaattaaacacatgaaattttggcgtaaagcagggggaggattgattggaagaaaaggctacataggcacactggggaaaaatgacacaatgatgtgtgcagtgtatggatggactgaagagatggctttttctggaacatccacaggagatgtgtgtatctggagagacatctttcttgtaaaaacagtgaaagcgcatgatgggccagtgttcagtatgcatgcattggaaaaagggtttgtaactggaggaaaagatggtatagtagctctttgggatgactcttttgaaagatgtctcaagacctatgctataaaaagagctgcattggccccaggatctaaaggtcttctcttggaagataatccatctatacgtgccatatcattaggacatggtcatattttagttggcacaaagaatggtgaaatactagaagtggataaaagtggcccaataacacttctggttcagggacacatggaaggagaggtgtggggtttagctacacacccttatctgcccatctgtgctactgtaagcgatgataaaaccttaagaatatgggatctctcacctagtcattgtatgttggctgtccggaagctgaaaaagggtgggaggtgttgctgtttttctcctgatggtaaagctttagccgtaggtctcaacgatggaagcttcttaatggcaaatgcggatactctagaggatcttgtgtcttttcatcacagaaaagatatgatttcagatattcgattttcacctggttctgggaaatatcttgctgtagcatcccatgacagctttatagatatatacaatgtaatgagtagtaaacgagtaggaatatgcaaaggagctaccagttacataacccatattgattgggatattagaggaaagcttttacaggtcaacactggtgctaaggaacaattattctttgaagctcccagagggaaaaaacaaaccatccccagcgtggaggtagaaaaaattgcttgggcatcatggacaagtgtacttggtttatgctgtgaaggaatttggccagtaattggagaagttacagatgtaactgcttcttgcctcaccagtgacaaaatggttctagctaccggggacgatttgggatttgtgaagttatttagatatcctactaaagggaaatttggaaagtttaagaggtatgtggcccatagtacacatgtcacaaatgttcgctggacttatgatgacagcatgttggttaccctaggcggtacagatatgtctttaatggtgtggacaaatgagatggaaggctatcgagaaaaaaggccttgtgatagtgaagaatccgacattgattctgaagaagatgggggctatgacagtgatgttacaagggagaatgaaatcagttacaccatcagagccttatcaacaaatattcgcccaatgttaggaatcaagcctcatttacaacaaaaagaaccctcaattgatgaaaggcagggagtagtaagaggttccaggcctccagtgagcagggccccaccacagccagagaaactccagacaaacaatgtaggcaagaaaaagagacctatagaggaccttgtgttggagctcatttttggttatcgaggcagagactgtaggaataatgttcactatttaaatgatggtgatgatataatttatcacactgcatctgttggaattctgcacaatgttgctacaggttctcagagtttttatcaggaacataatgatgatattctgtgcctcacagtaaaccagcaccccaaatttatcaacatagtggcaactggccaagtaggtgattcagcagacatgtcagctacagctccttctattcacatctgggatgcaatgaacaagcagactttatctatcctaagatgctaccattcaaagggagtatgttcagtcagcttcagtgctactggcaaactattgctgtctgtgggactagacccagaacatactattaccatttggagatggcaggaaggtgccaaaattgccagcagagctggtcacaatcaacgtatttttgtggcagaattccgaccagattcagatacccagtttgtctcagtgggagtaaaacatgtgaagttctggaccctggcaggaagagctcttcttagcaaaaaagggctactgagcacactggaagatgcccggatgcagaccatgctcgctattgcatttggtgcaaataacttgacgtttacaggtaccatcagtggtgatgtctgtgtgtggaaagatcacatattgtgtagaatcgtggcgagagctcacaacgggcctgtgtttgccatgtacaccaccctgcgagatggacttatcgtgactgggggaaaggaaaggccgtcaaaagaaggaggagcggttaaactgtgggatcaggaactgaggcggtgccgtgccttcaggcttgagacaggacaagccacagattgtgttcgttctgtgtgcagaggcaaaggcaagatccttgttgggacaaggaatgctgaaataatcgaagttggagagaaaaatgcagcttgtaatattttagttaacggtcatgtggatgggccaatctggggactagcaacacatccttccagggattttttcctttctgctgcagaagatgggacagtgagactttgggatattgctgataaaaagatgttaaacaaagtgaatttgggacatgctgctcgtactgtgtgttacagccctgaaggggacatggtggctattggaatgaaaaatggagaatttatcattttactagtgagttctctaaaaatatggggaaagaagagagacaggagatgtgcaatccatgatatcagatttagtccggattcccggtatctggcagtaggttctagtgagaactcagtggatttttatgacctaacgctgggccccactcttaacagaatcagctactgcaaagacattccaagctttgtcattcaaatggacttctctgcagatagcagttatctccaggtctctagtggctgctataaacggcatgtctatgaagtgccttcaggaaaacatcttatggatcatgccgctattgacagaattacttgggctacatggactagtattctaggagatgaggttttgggaatctggtccagacatgctgagaaagctgatgtcaactgtgcctgtgtatctcattcaggaatcagtcttgttacaggagatgactttggcatggttaagttatttgacttcccatgtccagaaaaatttgcaaaacacaaaaggttcttgggtcattcgccccatgtgacaaatattcgatttaccagtggtgatcgacatgttgttagtgctggaggtgatgactgcagcttatttgtctggaaatgtgtacatacacctcactgagagatgctgagatgactacagaaattaactttgagaccagaattacagagaagaaaaaccaaaacccaaccctgcatggtcaagtggtgctaacccaagactgtaacagggagaaatgcccagaatcatcaaaatagtgaaagactgatctgttcaaaatatttgctatatgcactgggtataatccgtaatccatacactgccagataatgccatttcaaggaaggatcgaatacttgatggtaaaggccaagtccccctgtattgggaagtgtgtgatttcggcagacctgctgggaaaatttagggtagagcactctttacagaagaactcaaaaacccaatttggataattttcattatctttttagcaaaatggtttcttaatgtttatattttattttcaaggttcattgtttaatgaaatattttattcttgcatttccataaggaaagggaaagtcatgatcatcctaaaggatcacagtttttaaaaggcaaacattttccctaaggaaacagacacaagctttcctagagaatatgatgttttttaggcattaataaggtccttttttataaaggacacttttctcctagtagttttgaattcaggaacagatccaaagttagcagtatatggctgctacatttccattttcattttcgagccatcagtttatgttcagatgccatctctgtaatcgcacatttaaaacataactgtagcctcactaatggaaaagtagtatgatgaacaatcattcccaatggtgtacaatgtaagggttttagggagcaacagtatttaactggaagaaagaattgcatatttaatgtagtctaatatatacacatttgtttaacatgtaaacaaaagtgttaaattcacatatacaacattatacaatttaatcactcttggaataaaatttttatagccttttttctattgggaaaatttgtttagatgtgtgccactccataggtttatttccaaaatgaatgagcccaactccatttgtaaaaacttgtcagttagaattcctttttttagtggattagggctgaattcttagatccttatttcttttcactttaaatgctgccaaagatcactactcatcattcaggaattcgctgtctagcctatctgtagtttcctgaagattgaaaattatgtagactgctatttaaaaatatatttttctaagtgtgaggtttaagatgctgtattgaccctatgagtttttaatgtgttaattatctttatagcataatagatcgctttaggttcctggaatcccatttggtctgacaggatatatgaagattcttaatacctattttctgtgtctaatacttggttaatactaaaaatagaaatgactaaattacatcacagaaagcataaccagtgattgaacctggtagttttaaagctctaaatagctgtggctgaaggactgattatggggctaagaagcttgaaacgtaagttggtacttgttcatcagtggattctcctaaattaagccaaattttgaaatacatgactattaagtttctactcatgtatttacagtcagtcaataaattaaaggaggaaaaaaatccctgaacaacctgcccataaaaagaaaaatactctacatttgagcctgctgcagttttaaattttccctctgggtcaagtttgccagcttttggctacagagaaattatatttccattacagtgcaggtagaaactctgtaaccttaagcatgtaaactacatagaataaaactgtttccactgcatttctgtccttcaaagtggccaacctgattaagtcagccttaatcactgctgctgtcagtttcacgactaaaggtcatattgactaagtagtcatcagctgaccacctcgctgtatcagccagcaacgaggggaaggtgaagaaacatgataggccatatagaatctgccctatgtttacttttttaacccagataattatttttgtgtgcagtatctaagctcctgattgtgtaacctgggacttctggcaccttttgttccattcattttatgtataaaatgcatgccaaagcacactgtgccctctggtacccttgcttccaatcgccaaccatgctcatttccttcctttttttgtggtccctttttgtggtgatcattttaaaccacgtcatccaacaaatgttttatggtcaaccttagcttgttcataagccatagcaactgaaagattaaactcttaaatatgtgtctgggcagtggctattaaatagcaaaaaacaatcagattttagtattttattatttccttgtaaaatggctgaactaaattaaacccttgtttcccatttgttctataatttatagtgaaactgagaacaaaactatctttataaatgatagctaaaagtatttccagatatttaaacaatttaaaataaatttcttctgcagagatgcaaagcatctcaacactggaatgaacaaatgccttaaattcaatggagtaaacctttagaatgaagaggaactgtcatttcacccaagccgaagacaacagccttatgcacttgtgtgctctgtctttgctgcttctcgtgtttcaagcctttcctgtgggatcagcacagcaaagtgcaacttaccaaatggtttaatgactggttaattctttcttctcccaatggaaaagcaatggcaacacaacagtagactgctggcttgacaatcttaaacgtgagcctttgcacatgtaggtttatcatcatttgagtatacgactaagcaagtcaatgaactttttttttttttttagcagtttaatttggtcctgagaatgttgcagtctttattaccccttttgcattaatccacttttctaaccaccttttaagctttaatttttaacactatacaccaagtctttgaaatcagtgatctgttatttaactctaaagcatttgacacttcttgccttaacagttttaaaaaccacacacaaaaaaactctgtaagtaatacagtaggccaaaagtttcatcctatctatcttgcagtttacctatctgatctgatctctgtaattatagttctgtcatttaaaatatactatttaaatctaatttttacatttcaaaaattatcttcagtagtaactaagtatattttctgtggattctgagaatgttatttttcagaatgtgagaatatatatgtacatttataatcttgtgactttaaagtctgttttcagatacagtatgtaaatacttgtaaaaaaatttgtataattttgtgataatgtagtttcccaaaaaaattatttagaaggcattatgttattagtaaatgagagcactgta

SEQ ID NO: 128998 - DNA, 770 bp, Homo sapiens
  Payload ID: 5228
  Gene Symbol: EML5
  Gene Name: echinoderm microtubule associated protein like 5
  ENST ID: ENST00000555823
  CDS Start-End: 1-770
gggctactgagcacactggaagatgcccggatgcagaccatgctcgctattgcatttggtgcaaataacttgacgtttacaggtaccatcagtggtgatgtctgtgtgtggaaagatcacatattgtgtagaatcgtggcgagagctcacaacgggcctgtgtttgccatgtacaccaccctgcgagatggacttatcgtgactgggggaaaggaaaggccgtcaaaagaaggaggagcggttaaactgtgggatcaggaactgaggcggtgccgtgccttcaggcttgagacaggacaagccacagattgtgttcgttctgtgtgcagaggcaaaggcaagatccttgttgggacaaggaatgctgaaataatcgaagttggagagaaaaatgcagcttgtaatattttagttaacggtcatgtggatgggccaatctggggactagcaacacatccttccagggattttttcctttctgctgcagaagatgggacagtgagactttgggatattgctgataaaatgttaaacaaagtgaatttgggacatgctgctcgtactgtgtgttacagccctgaaggggacatggtggctattggaatgaaaaatggagaatttatcattttactagtgagttctctaaaaatatggggaaagaagagagacaggagatgtgcaatccatgatatcagaatcagctactgcaaagacattccaagctttgtcattcaaatggacttctctgcagatagcagttatctccaggt

SEQ ID NO: 128999 - DNA, 3925 bp, Homo sapiens
  Payload ID: 5228
  Gene Symbol: EML5
  Gene Name: echinoderm microtubule associated protein like 5
  ENST ID: ENST00000553281
  CDS Start-End: 1-617
cagatggaacttaccttgctgttggatgcaatgacagctcggttgatatttatggagttgctcagcgttataaaaaagttggcgagtgtttgggatcccttagtttcatcactcatctggactggtcttcagacagtagatatttgcagacaaatgatggaaatgggaaaagacttttttatagaatgccaggaggaaaggaagtgacaagtacagaagaaataaaaggtgttcattgggcttcatggacatgtgtttcaggccttgaagtaaatggaatttggcccaagtattcagatatcaacgatataaattcagtagatggaaattatattggccaagttttagttacagctgatgactatggaattataaaattattccgatatccatgtttaagaaaaggggccaagtttagaaaatatattggccattcagctcacgtaactaatgtcagatggtcacatgattatcagtgggttatttctattggtggagcagatcactctgtctttcagtggaaatttattcctgaaagaaaactgaaagatgctgttcacatagcaccccaaggttatattcacttatatttgcacagacatttaaatttgatgtagcggtcattggggagccagtgaagggatttaaaggagctattgagtttgcagtgagtggagaggaagataatctgtagtacagtttactgacatctgtgtcacttgaatagaaagtctggctgactctcatagtgatgaatcagattcagatctgtctgatgttccagaactggattctgaaattgaacaagagacacagctcacctaccgtcgacaggtttacaaagaagatctacctcagcttaaagaacagtgcaaagagaaacaaaaaagtgctacttctaaaagaagagagcgggctccaggaaatagtattcgattacactttgttcacggttacagaggttatgactgtcgaagtaatctgttttatactcaaattggtgaaattgtgtaccatgtggcagcagtgggtgtcatttataatcgacagcaaaacacacagcgtttttatctgggtcatgatgatgatattctctgcctaactattcatcctttgaaagactacgtggcaacaggccaggttggtagagatccctcaattcatatatgggatacagagaccattaaaccattgtccatattaaagggccaccaccagtatggtgttagtgccgttgatttctcagcggatgggaaacgtttggcatcagttggcatagatgatagccatactgttgtgctctgggactggaagaaaggagagaaactttcaatagcaagaggaagtaaagataagatttttgttgtaaagatgaacccctatgtgcctgataaactaattacagctggaattaaacacatgaaattttggcgtaaagcaggagatgtgtgtatctggagagacatctttcttgtaaaaacagtgaaagcgcatgatgggccagtgttcagtatgcatgcattggaaaaagggtttgtaactggaggaaaagatggtatagtagctctttgggatgactcttttgaaagatgtctcaagacctatgctataaaaagagctgcattggccccaggatctaaaggtcttctcttggaagataatccatctatacgtgccatatcattaggacatggtcatattttagttggcacaaagaatggtgaaatactagaagtggataaaagtggcccaataacacttctggttcagggacacatggaaggagaggtgtggggtttagctacacacccttatctgcccatctgtgctactgtaagcgatgataaaaccttaagaatatgggatctctcacctagtcattgtatgttggctgtccggaagctgaaaaagggtgggaggtgttgctgtttttctcctgatggtaaagctttagccgtaggtctcaacgatggaagcttcttaatggcaaatgcggatactctagaggatcttgtgtcttttcatcacagaaaagatatgatttcagatattcgattttcacctggttctgggaaatatcttgctgtagcatcccatgacagctttatagatatatacaatgtaatgagtagtaaacgagtaggaatatgcaaaggagctaccagttacataacccatattgattgggatattagaggaaagcttttacaggtcaacactggtgctaaggaacaattattctttgaagctcccagagggaaaaaacaaaccatccccagcgtggaggtagaaaaaattgcttgggcatcatggacaagtgtacttggtttatgctgtgaaggaatttggccagtaattggagaagttacagatgtaactgcttcttgcctcaccagtgacaaaatggttctagctaccggggacgatttgggatttgtgaagttatttagatatcctactaaagggaaatttggaaagtttaagaggtatgtggcccatagtacacatgtcacaaatgttcgctggacttatgatgacagcatgttggttaccctaggcggtacagatatgtctttaatggtgtggacaaatgagatggaaggctatcgagaaaaaaggccttgtgatagtgaagaatccgacattgattctgaagaagatgggggctatgacagtgatgttacaagggagaatgaaatcagttacaccatcagagccttatcaacaaatattcgcccaatgttaggaatcaagcctcatttacaacaaaaagaaccctcaattgatgaaaggcctccagtgagcagggccccaccacagccagagaaactccagacaaacaatgtaggcaagaaaaagagacctatagaggaccttgtgttggagctcatttttggttatcgaggcagagactgtaggaataatgttcactatttaaatgatggtgatgatataatttatcacactgcatctgttggaattctgcacaatgttgctacaggttctcagagtttttatcaggaacataatgatgatattctgtgcctcacagtaaaccagcaccccaaatttatcaacatagtggcaactggccaagtaggtgattcagcagacatgtcagctacagctccttctattcacatctgggatgcaatgaacaagcagactttatctatcctaagatgctaccattcaaagggagtatgttcagtcagcttcagtgctactggcaaactattgctgtctgtgggactagacccagaacatactattaccatttggagatggcaggaaggtgccaaaattgccagcagagctggtcacaatcaacgtatttttgtggcagaattccgaccagattcagatacccagtttgtctcagtgggagtaaaacatgtgaagttctggaccctggcaggaagagctcttcttagcaaaaaagggctactgagcacactggaagatgcccggatgcagaccatgctcgctattgcatttggtgcaaataacttgacgtttacaggtaccatcagtggtgatgtctgtgtgtggaaagatcacatattgtgtagaatcgtggcgagagctcacaacgggcctgtgtttgccatgtacaccaccctgcgagatggacttatcgtgactgggggaaaggaaaggccgtcaaaagaaggaggagcggttaaactgtgggatcaggaactgaggcggtgccgtgccttcaggcttgagacaggacaagccacagattgtgttcgttctgtgtgcagaggcaaagtatttacaagagaggattttgaaagtttccatcacaaagaaatgataaatgtctgaggtgatggttatgcgtattaccctatgccctatagatatgtataattatgtgtcaatttcaaaataaaaattcaaaactacaactcctatg

SEQ ID NO: 129000 - DNA, 8320 bp, Homo sapiens
  Payload ID: 5229
  Gene Symbol: EML6
  Gene Name: echinoderm microtubule associated protein like 6
  Uniprot ID: Q6ZMW3
  ENST ID: ENST00000356458
  CDS Start-End: 521-6397
gatatagactgtcaatttcggatccaaagacggcgatggcagagctcacccgggttgcctgtcaaatcaaggctatcgcagaataaatcccgccgcctgccgcgaagccccggcgcaccgcaaacttcagtgagcgaactgggtgatcgctgttgggatatgcagattcctgatgtaaaaggcggggtggcccccccgagagcctctcccgggggccggagcccgcaggtgcagtgaggcgcgcgcgccggtgccggcgcccccagagccgccttgcccgggtagagggagcccggcgcccggcggggtctggcggccgcacaccggcggcggcggcttgtctgcggcggctgcagcggatgatggtggcggccggcccgctgggctgtgcctgtgtgtcgccgcggaaatcagcgccctgcgccgcgcgctgagcccctgcaggtccgccgcagccccagcctcggcgaggacggccccggcgcgcgggggggcggggggcgcgcggggtcggcttatcatggcggatcggacggcgccccgctgccagctccggctggagtgggtgtacgggtaccggggtcaccagtgccgcaacaacctgtactacacggcaggcaaggaggtggtctactttgtggctggggtcggggtggtttacaacacccgcgagcacagccaaaaattcttcctgggacacaacgacgacattatcagccttgccttacacccagacaaaactctcgttgcaactggccaagtcgggaaggagccatatatatgcatatgggattcctataatgtccagactgtgtctcttcttaaagatgtccatacacatggagttgcctgcctggcttttgactcagatggacagcgtttagcctctgtggggttggatgccaaaaacacagtctgcatttgggactggaggaagggaaaacttctggcgtcagccaccggccattctgacaggatttttgatatttcctgggatccatatcagccaaacagagtggttagctgtggagtaaaacacataaagttttggacactgtgtggaaatgccctgactgcaaaaagagggatatttggcaaaacaggggatcttcagaccatcctttgccttgcatgtgccaaagaagacatcacctactctggtgctttaaatggtgacatctatgtctggaaagggctcaatttagtccgcaccattcaaggagcacatagtgctggaatctttagcatgtatgcttgtgaagaaggctttgccactggtgggcgagatgggtgtatacgactgtgggacactgatttcaaaccaataaccaaaattgatctcagggagacagaacaaggatacaaaggcctctctatccggagcgtgtgctggaaagcagaccgccttctagcagggacccaggacagtgagatatttgaagtgattgtgcgagagcgagacaagccgatgttgatcctacagggccactgcgagggtgagctctgggctctggccctgcaccccaagaagcctctggctgtgacaggcagcgatgaccgctctgtcaggctgtggagcctggctgatcatgccttgatcgcccgctgtaacatggaagaggcggttcgcagtgtagctttcagccccgacggatctcagctggccctgggcatgaaggacggctctttcattgttctccgagtcagagatatgacagaagtagttcacatcaaagatcgaaaagaagtcattcatgaaatgaaattttctccagatggttcttaccttgcagtgggatccaatgatggcccagtagatgtctatgctgttgcccagaggtataagaaaattggagaatgcagcaagtcccttagtttcatcacgcatattgactggtccttggatagtaaatacttacaaactaatgacggtgcaggagaacgattgttctacagaatgccatctgggaagcctttaacaagtaaagaagaaattaaagggattccttgggcctcctggacatgcgtgaaaggccctgaagtgagtggaatttggcccaaatacactgaggttactgacatcaactcagtggatgcgaattacaacagctcagtgctggtgtctggagatgattttggactggttaaattgtttaaatttccttgtctcaagagaggagccaaatttagaaagtatgtgggccattctgcacatgtcacaaatgtccgctggtcccatgactttcagtgggtgttgagcacaggaggggctgatcactcagttttccagtggaggtttattccagaaggtgtcagcaacggcatgctggaaactgcaccccaagaaggtggagctgattcctacagtgaagaatctgattcagatttatctgatgtgcccgaactggactctgatattgagcaagaagctcaaatcaattatgatcgccaggtttacaaagaagatctacctcagctaaagcaacaaagtaaagagaaaaaccacgcagtgcccttcctcaaacgagaaaaggctcctgaggacagcttgaaactccagttcatacacggttatagaggctacgactgtagaaacaatctgttctacacacaagctggagaagtagtctaccacattgctgcagttgctgtcgtgtataatcggcagcagcactcccagaggctgtacctggggcacgatgacgacattctcagcctgaccatccatccagtgaaggactatgtggctactgggcaggttggaagagatgctgctattcatgtgtgggacacacaaactctaaaatgtttgtcgctgttgaaaggacaacatcagagaggagtgtgtgcacttgatttttcagccgatggaaaatgtctggtgtcggttggtttagacgattttcacagtattgtattttgggactggaaaaagggagaaaagatagccacaacaagaggacataaagataagatatttgtggtaaagtgtaacccacaccatgttgacaaactggttacagttgggataaaacacatcaaattctggcaacaagcaggtgggggcttcacttctaaaagaggaacttttggaagcgttggaaaattggaaacaatgatgtgtgtttcttacggacgaatggaagatctagtgttctcaggagcagctactggagatatttttatttggaaagacattctactactgaagacagtgaaagctcatgatgggcctgtgtttgctatgtatgcactggataagggctttgtaacaggtggaaaggacggcatcgtggagctctgggatgatatgtttgaaagatgtttgaagacttatgccattaaaagatcagcattgtcgactagctcaaaaggcttgcttttggaagataacccttcaattcgtgccatcactttgggacatggacatatcctggtgggaacaaaaaatggagagattctggaaattgataagagtggcccaatgacactgcttgttcaggggcacatggaaggagaagtgtgggggttggcagctcaccctctcctgcccatctgtgcaacagtgagcgatgataaaacacttcgcatctgggaactatctgcccagcaccgtatgctggcagtacggaaactcaaaaaaggtggaagatgctgtgccttttcccctgatgggaaagccttagcggttggcttgaacgatgggagtttcctggtggtaaatgctgacactgttgaagacatggtctctttccatcacagaaaagaaatgatctctgatattaagttttcaaaagatacgggaaaataccttgccgtggcatcccatgataactttgtggatatttacaacgtacttacaagcaaaagggttggcatctgtaaaggtgcttctagttatattacacacattgactgggactctagaggaaaattattgcaagtgaattcaggtgccagagaacaacttttttttgaagctccaagaggcaaacggcatataataagaccttcagagatcgagaagatagagtgggacacatggacctgtgtcctggggcccacctgtgagggaatctggccagcacatagcgatataactgacgtaaatgctgccagtcttaccaaagactgttcccttttagccaccggagatgattttggtttcgttaagcttttttcatatcctgtcaagggacagcacgcaagattcaagaagtatgtggggcacagtgcacatgtcactaacgtgaggtggctgcacaatgactctgtgctgctcacggtgggcggcgccgacacagccctgatgatctggaccagggagtttgtggggacccaggagagcaagctggtggacagcgaggagtcagacaccgacgtggaagaggatggaggctatgacagcgatgttgctagagaaaaggccattgactacaccaccaagatttatgctgtgagcatcagggaaatggaaggcaccaagccacaccagcagctgaaggaagtttccgtggaagaaagaccacccgttagccgagcagctccccagcctgagaaactgcagaagaacaatatcaccaaaaaaaagaaactggttgaggagctggctctagaccacgtgtttggctacagaggtttcgactgtcgaaataacctgcattaccttaatgatggcgctgacatcatcttccacacagcagcggctggcatcgttcagaacctctccacagggagccagagcttctatctggagcacacagatgacatcctctgtctcacagtgaaccagcaccccaagtacagaaacgtggtggccaccagccagatagggacaacaccttccatccacatatgggacgccatgaccaaacacaccctctccatgctgcggtgcttccactccaagggggtgaattacatcaacttcagtgcaactggaaagctcctggtgtcggtgggagtggaccctgagcacaccatcactgtctggcgatggcaggaaggtgccaaggttgccagccgagggggtcacctggagcgcatatttgtggtggaatttcgccccgactcagacacgcagtttgtatctgtcggggtcaaacatatgaagttctggaccctggcaggcagcgccttgctttacaagaaaggggtcatcgggtccctgggagctgccaaaatgcagacgatgctctccgtggccttcggtgctaacaatctcactttcacgggtgccatcaatggagatgtctacgtctggaaggaccacttcctcatccggctggtggccaaggctcacacaggccccgtgttcacaatgtacacaacccttcgggatggactcatagtgaccggcggaaaagagaggccgaccaaagaaggaggtgctgtaaaattgtgggaccaggagatgaagcgctgccgggcctttcagctggagaccgggcagctggtggagtgtgtgcgctccgtgtgccgtggaaaaggaaaaatcttagtgggaaccaaagacggagaaataattgaagttggtgaaaaaaatgctgcttctaacatcctgattgatggtcacatggaaggggagatctggggcctggccactcacccttccaaggacctcttcatctctgccagcaacgatggcacagcccggatctgggacctggctgacaagaagctgttaaacaaggtgagcttgggccatgcggccaggtgtgcagcctacagccctgatggggagatggtggccattggcatgaagaatggagagtttgtcatcttgttggtgaacagcctgaaagtttgggggaaaaaacgagaccggaaatctgctatccaagatatcagaatcagcccagacaaccgattcttagccgttggttcttctgaacacacagttgacttctatgacctcactcagggcacaaatctgaaccgcattggctactgcaaagatatcccaagctttgtcattcagatggatttttctgcggatggcaaatacattcaggtgtcaacaggtgcctataagcgccaggtgcatgaggtccccctggggaagcaggtaactgaagccgtggtcattgagaagatcacctgggcctcctggacaagcgtcctgggagatgaagtcattggaatctggccacgaaatgcagacaaggctgatgtcaactgcgcatgtgtgacccacgctggcctgaacattgtcacaggagatgactttgggctggtgaagctctttgattttccatgcacagaaaaatttgccaaacataagcgatacttcggtcactcggctcacgtgacgaacatccgtttctcttatgatgacaagtatgtggtcagcactggaggagacgactgcagtgtatttgtgtggcgatgtctgtaaaatgccagaagcctcttatgttattgctgctgctgctaccagccagcaactgcagaggccatgctgaggtgcctccttgccaccagccgttgggaaatgcctaccatgctgccccggatgcacaagctcaaaacgctgcagaagttacacaactgctcccataatctggactctccaaaaccgtgatgccacgaaggaaggtcaagttttaaaatgttaaagactgcttgcctctgttcctgagactaaacagtatacatactaactacattgacaaagaaatcctatctgataatgtagcccgctgacgaattttgaagcctcggttaccctaaccaatatgtagcttttaatttgcatcaaaacttttacaaagatgttttgctattgtttctatatacttcaagaatgttcatttttacaaataagttgaacaagacagcctaagttagatgcaccgaagtactagaaatatcgctagcctctgttctccagtttagctttcaaaaccaaatgagccatgtataaaggagttgagaaacttaatttttaaatgtttcatttgcagagttttatatccattaagtgcctttgaaagtttccagttgtgtgggctgctgtctcacctcccaccaatttctcctttctccatatggtgctaaaacctcaaagctgaggagggctgcaggacccttagcagattcagtgtgtcacccttgtcctgtgttcacgccaaggcttcctaaatgaaagacatcggttacctgcttatgggaaggtgagcagcaaaggaattgaagttcgggacagggtagaattatgggttttcattgtgtttcatgccaaacccacaaaatccaaaatagaattcaagttaaacaaacttctactacaaaatggaaggggaaaaaggctcaggaaggtctatgagaatgagctgacttatctcgttaaatcttaagataaatgagggtaacccaaggctgcaccttggtgtaccaccctgagtggagttgaggtgacttcatttgattgcttcaggcgaactatataggtcaagtccagattataaaaaaattatctgcagaacaaattgtaaacccaaggaatagctggtaaatcaaaattataaagtgagttagagttccttggagttggttgtatgacggaatatgacttggacaatctttaccagaagccatccgtaagcccctcagtcacactttccatgtagctgaccagtgactacaggatgtggctgacagtgctcactgaaaggagagttggtgcgggactggtggttctgagcacatagacgcctattagtccttctggtcagtgaacgaaaattctagacctacagttactggctacttgcatttgtcagtttagagaaaaggtaaaatgaggcattttcaattgtagaatagactaacatttaccacagaagtgcttcagcattctaaatggattagatcactcattaagctatttttatatgccaatttactaatgccttacatcaatccactaataggttgttgggcccgcagtagagtccctatgcagtcccaattctgttttctgtaaccatgtgactggtgatgcagagtgataaccatgtctgcctatcttgtactagactcttcatgctgatcggatcttgcattgaaataaccatgtggaagaacaatgaatcgattaatgatgacatgtacaaccatatttaaagagcaatagtgtccgtgtgtcatgaaaaacttatttgtaaacgtttatatggtatgattttgattttatgtatgttcataaatcctgcactgtatgatatatgtgagttaaaacattggtgcatgaatttattttcaaagtataaaacacatcacttaaacattttatgtgtcaaataaaatttgattatgt

SEQ ID NO: 129001 - DNA, 1860 bp, Homo sapiens
  Payload ID: 5230
  Gene Symbol: EVI2A
  Gene Name: ecotropic viral integration site 2A
  Uniprot ID: P22794
  ENST ID: ENST00000247270
  CDS Start-End: 338-1117
agagaagttggagctttttcgttgtttttttttttttccctcctgtgacatgtgctttagttgcagtggaaaggaaatgtgtcatctgtggtttggttttaaaagtggaaaactagctgcacatatccttttttactgcagatttactttaaggctcatattctccaagtctattctgctttaaaaagaagacaagaaaagaagtggtttatcaaaatcacgttataatcagattttgaccaagcattttgtaagtatacaaatgtcagccaatgacatataacaaccatttcttataaaaccttgatgttcaaaagcctgactagcagtggcatccatgttgcttaggagttggtttggaaacaaagactttcaggccctacctatactagctagattgccaagcatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaaccaaaatgaaaacattaacacaaaccctataactcctgaagtagattataaaggtaattctacaaacatgcctgaaacatctcacatcgtagctttaacttctaaatctgaacaggagctttatataccttctgtcgtcagcaacagtccttcaacagtacagagcattgaaaacacaagcaaaagtcatggtgaaattttcaaaaaggatgtctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatttagaatcaagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttccttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataaacctgtgaccacgtatatttgcattcactttattactttagagaacacattgtaaagatcaataagaaatagagcacaactaaaataaataagatttatagccacaccaata

SEQ ID NO: 129002 - DNA, 1540 bp, Homo sapiens
  Payload ID: 5230
  Gene Symbol: EVI2A
  Gene Name: ecotropic viral integration site 2A
  Uniprot ID: P22794
  ENST ID: ENST00000461237
  CDS Start-End: 87-797
atacagtttgtttatttgggcactgcagtacatctggctgaagacaatcaacagcaggcctattatctgttccgtgattgccaagcatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaaccaaaatgaaaacattaacacaaaccctataactcctgaagtagattataaaggtaattctacaaacatgcctgaaacatctcacatcgtagctttaacttctaaatctgaacaggagctttatataccttctgtcgtcagcaacagtccttcaacagtacagagcattgaaaacacaagcaaaagtcatggtgaaattttcaaaaaggatgtctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatttagaatcaagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttccttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataaacctgtgaccacgtatatttgcattcactttattactttagagaacacattgtaaagatcaataagaaatagagcacaactaaaataaataagatttatagccacaccaata

SEQ ID NO: 129003 - DNA, 1854 bp, Homo sapiens
  Payload ID: 5230
  Gene Symbol: EVI2A
  Gene Name: ecotropic viral integration site 2A
  Uniprot ID: P22794
  ENST ID: ENST00000462804
  CDS Start-End: 401-1111
cttttgaatgacactaaagcatgtagcaggcctatagaatgagcatactgtcaaaaggcattaagtggaaaaccctccctgctctggaggcggggattggttctacaaagcctcctgtcatgccagtggccaactagagaagttggagctttttcgttgtttttttttttttccctcctgtgacatgtgctttagttgcagtggaaaggaaatgtgtcatctgtggtttggttttaaaagtggaaaactagctgcacatatccttttttactgcagatttactttaaggctcatattctccaagtctattctgctttaaaaagaagacaagaaaagaagtggtttatcaaaatcacgttataatcagattttgaccaagcattttgtaagattgccaagcatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaaccaaaatgaaaacattaacacaaaccctataactcctgaagtagattataaaggtaattctacaaacatgcctgaaacatctcacatcgtagctttaacttctaaatctgaacaggagctttatataccttctgtcgtcagcaacagtccttcaacagtacagagcattgaaaacacaagcaaaagtcatggtgaaattttcaaaaaggatgtctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatttagaatcaagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttccttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataaacctgtgaccacgtatatttgcattcactttattactttagagaacacattgtaaagatcaataagaaatagagcacaactaaaataaataagatttatagccacaccaata

SEQ ID NO: 129004 - DNA, 1999 bp, Homo sapiens
  Payload ID: 5231
  Gene Symbol: EVI2B
  Gene Name: ecotropic viral integration site 2B
  Uniprot ID: P34910
  ENST ID: ENST00000330927
  CDS Start-End: 156-1502
agaaactatttcagtttgctagaggaacattttaaatctgaattgaaccacccattttcctttcttagccaaatcaccaaaatgtccagttagaacaagaatttagcattctgcaaaagaagttaacagctgagataacgaggaaatattctgaaatggatcccaaatatttcatcttaattttgttttgtggacacctgaacaatacatttttttcaaagacagagacaattacaacagagaagcagtcacagcctaccttattcacatcatcaatgtcacaggtattggctaattctcaaaacacaacagggaatcctttgggtcaaccaacacaattcagcgacactttttctggacaatcaatatcacctgccaaagtcactgctggacaaccaacaccagctgtctatacctcttctgaaaaaccagaagcacatacttctgctggacaaccacttgcctacaacaccaaacaaccaacaccaatagccaacacctcctcccagcaagccgtgttcacctctgccagacaactaccatctgcccgtacttctaccacacaaccaccaaagtcatttgtctatacttttactcaacaatcatcatctgtccagatcccttctagaaaacaaataactgttcataatccatccacacaaccaacatcaactgtcaaaaattcacctaggagtacaccaggatttatcttagatactaccagtaacaaacaaaccccacaaaaaaacaattataattcaatagctgccatactaattggtgtacttctgacttctatgttggtagctataatcatcattgtactttggaaatgcttaaggaaaccagttttaaatgatcaaaattgggcaggtagatctccatttgctgatggagaaacccctgacatttgtatggataacatcagagaaaatgaaatatccacaaaacgtacatcaatcatttcacttacaccctggaaaccaagcaaaagcacacttttagcagatgacttagaaattaagttgtttgaatcaagtgaaaacattgaagactccaacaaccccaaaacagagaaaataaaagatcaagtaaatggtacatcagaagatagtgctgatggttcaacagttggaactgctgtttcttcttcagatgatgcagatctgcctccaccacctccccttctggatttggaaggacaggaaagtaaccaatctgacaaacccacaatgacaattgtatctcctcttccaaatgattctactagtctccctccatctctggactgtctcaatcaagactgtggagatcataaatctgagataatacaatcatttccaccgcttgactcacttaacttgcccctgccaccagtagattttatgaaaaaccaagaagattccaaccttgagatccagtgtcaggagttctctattcctcccaactctgatcaagatcttaatgaatccctgccacctccacctgcagaactgttataaatattacaacttgctttttagctgatcttccatcctcaaatgactcttttttctttatatgttaacatatataaaatggcaactgatagtcaattttgatttttattcaggaactatctgaaatctgctcagagcctatgtgcatagatgaaacttttttttaaaaaaagttatttaacagtaatctatttactaattatagtacctatctttaaagtatagtacattttacatatgtaaatggtatgtttcaataatttaagaactctgaaacaatctacatatacttattacccagtacagttttttttcccctgaaaagctgtgtataaaattatggtgaataaacttttatgtttccatttcaaagaccagggtggagaggaataagagactaagtatatgcttcaagttttaaattaatacctcaagtattaaataaatattccaagtttgtgggaatgggagattaaaatgcatgtttgagaatagagaaa

SEQ ID NO: 129005 - DNA, 1597 bp, Homo sapiens
  Payload ID: 5231
  Gene Symbol: EVI2B
  Gene Name: ecotropic viral integration site 2B
  Uniprot ID: P34910
  ENST ID: ENST00000577894
  CDS Start-End: 222-1568
atttcagtttgctagaggaacattttaaatctgaattgaaccacccattttcctttcttagccaaatcaccaaaatgtccagttagaacaagaatttagcattctgcaaaagaagttaacagctgagggccatttatcatcactgtgtaccaagtggtagaggagtaagcaatgatatgctgtttagatatgctgaaaagataacgaggaaatattctgaaatggatcccaaatatttcatcttaattttgttttgtggacacctgaacaatacatttttttcaaagacagagacaattacaacagagaagcagtcacagcctaccttattcacatcatcaatgtcacaggtattggctaattctcaaaacacaacagggaatcctttgggtcaaccaacacaattcagcgacactttttctggacaatcaatatcacctgccaaagtcactgctggacaaccaacaccagctgtctatacctcttctgaaaaaccagaagcacatacttctgctggacaaccacttgcctacaacaccaaacaaccaacaccaatagccaacacctcctcccagcaagccgtgttcacctctgccagacaactaccatctgcccgtacttctaccacacaaccaccaaagtcatttgtctatacttttactcaacaatcatcatctgtccagatcccttctagaaaacaaataactgttcataatccatccacacaaccaacatcaactgtcaaaaattcacctaggagtacaccaggatttatcttagatactaccagtaacaaacaaaccccacaaaaaaacaattataattcaatagctgccatactaattggtgtacttctgacttctatgttggtagctataatcatcattgtactttggaaatgcttaaggaaaccagttttaaatgatcaaaattgggcaggtagatctccatttgctgatggagaaacccctgacatttgtatggataacatcagagaaaatgaaatatccacaaaacgtacatcaatcatttcacttacaccctggaaaccaagcaaaagcacacttttagcagatgacttagaaattaagttgtttgaatcaagtgaaaacattgaagactccaacaaccccaaaacagagaaaataaaagatcaagtaaatggtacatcagaagatagtgctgatggttcaacagttggaactgctgtttcttcttcagatgatgcagatctgcctccaccacctccccttctggatttggaaggacaggaaagtaaccaatctgacaaacccacaatgacaattgtatctcctcttccaaatgattctactagtctccctccatctctggactgtctcaatcaagactgtggagatcataaatctgagataatacaatcatttccaccgcttgactcacttaacttgcccctgccaccagtagattttatgaaaaaccaagaagattccaaccttgagatccagtgtcaggagttctctattcctcccaactctgatcaagatcttaatgaatccctgccacctccacctgcagaactgttataaatattacaacttgctttttagctgatctt

SEQ ID NO: 129006 - DNA, 7403 bp, Homo sapiens
  Payload ID: 5232
  Gene Symbol: EVI5
  Gene Name: ecotropic viral integration site 5
  Uniprot ID: O60447
  ENST ID: ENST00000370331
  CDS Start-End: 11-2443
tctgcttatcatggttaccaacaaaatgactgctgcctttagaaaccctagtgggaaacaggtggcgacagacaaagttgcagaaaagctgagctctactctctcatgggtgaagaacacagtatcgcatacagtcagtcagatggccagtcaggtggcaagtccatctacttcattacataccacatcctcatctaccacactatcaacaccagccctttcaccatcttccccatcacagttgagtccagacgacttagaactcctggctaaactggaagaacagaatagattgttagaaacggatagtaagtctttaagatctgtaaatgggtcaagaagaaacagtggctcttctcttgtgtcgagttcatcagcctctagcaacctcagtcaccttgaagaagattcttggattctttggggaagaattgttaatgaatgggaagatgtacgcaaaaagaaggaaaagcaagttaaggaacttgttcataaagggataccccatcactttagagcaatagtttggcaacttttatgcagtgcacaaagtatgccaattaaggatcagtattcagaactcctgaaaatgacctcgccttgtgaaaaattgatccgaagggacattgctagaacttaccctgaacacaacttttttaaggaaaaagatagccttggacaggaggttttatttaatgtaatgaaggcttactctttagtagatcgtgaggttggttactgtcaaggaagtgcttttatagttggattgttgcttatgcagatgccagaagaagaagctttctgtgtatttgttaaattaatgcaagattatagacttcgtgaactttttaaaccaagtatggcagaattgggcctttgtatgtaccagtttgaatgtatgatacaggagcatcttccagagctctttgtacattttcaatctcagagttttcatacctcaatgtatgcatcatcctggtttctgactatctttcttacaacttttccactaccaattgcaacaaggatatttgatatctttatgtctgagggtttagaaatagtgtttcgtgtaggattagcacttcttcagatgaatcaggcagaactgatgcaacttgacatggaagggatgttacagcactttcaaaaggtcattccacatcagtttgatggtgtcccagacaagctaatccaagcagcttaccaagtcaaatacaattcaaaaaaaatgaaaaagcttgaaaaggaatacactacaataaaaacgaaagaaatggaagagcaagttgaaattaaaaggttacgcacagaaaatagacttttaaaacagcgcatcgagacattagaaaaacataaatgcagttccaactacaacgaagattttgtgctacagctagagaaggaattggtccaagcccgactgagtgaagctgagtctcagtgtgcattaaaagagatgcaggataaagtcttggatatagagaagaggaataactcccttcctgatgagaataatattgcaaggcttcaggaagaactcattgctgtgaaacttagagaagcagaagccattatgggtttgaaagaacttagacagcaagtcaaggatttagaggaacactggcagcgccacttagctcgtactactgggagatggaaagacccacccaagaaaaatgctatgaatgagttacaagatgaactgatgaccattcgacttagagaagctgaaacacaagcagaaataagagaaataaaacaaaggatgatggaaatggaaacacagaaccagatcaatagtaaccatcttcgaagagcagaacaagaggtgattagcctacaggagaaagtgcagtatctttctgcacagaacaaaggactccttactcaattaagtgaagcaaagcgtaaacaagcagagattgaatgcaagaataaggaagaagtgatggctgtgaggcttcgggaagcagatagcatagctgctgtggctgaactacgacaacacattgctgagcttgaaatccagaaagaagaaggaaagcttcaaggacagcttaacaagtctgattctaaccagtatattggggaactgaaagatcagatagcagagctgaatcatgagctcaggtgcctaaaaggccagaggggcttctcaggccaacctccttttgatggaatccacattgtcaaccatttaataggagatgatgaatcattccattcctccgatgaagattttatagataattccttacaggaaactggtgttggttttcctttgcacggaaaatctggttcgatgtctttggaccccgcagtggcagatggtagtgagagcgaaacagaagacagtgtgctggagaccagagagagcaaccaagtggttcaaaaggagcggcccccgagaagaagagagtcgtattcaaccactgtctgaccatcactgtgacctagactatggatttatttaagggatcagttatcatatgattagggctttttggaaataatttgtttcatatgtacatatatatatatatatatatatatatatatatatatatatatatatatatatatattttacagtcttatctgcctttttatctttgccaaatctttaccactgatttaccattgccataaagtagactggtatatggttaatgtgtaaaacaaggttctaacagtattactgaatattaatgtttcttgtttagaaaatgcaactatatctatatgtgggaaccattctgaagttcaaaactatggaaaattgaattttcttcagacaaaactgctcttgtgcaatattttatgctcagtgagcaaattgtgtatttatgtttatcaatttgttctcaaggtggctgtctacagacatttgaccaagacatacatctgatttaccttgtgtttttttttttattgttgtttttttttttaagacagagattcagtctgtcacccaggctggagtgctgtggtgtgatcttagctcactgcaacctccgcctcccaggttcaagcaattttcctgcctcagcctcccgagtacctgggactatatgtgcgcaccaccacgcctggctaattttttgtatttttagtagagatggggtttcaccatgttggctgggctggtctcgaactcctaacctcaagtgatccacccgcctcagcctcccaaagtgctgggattacaggtgtgagccactgcacccagcctaccttgtctgtttgtgtctgggaggttttttttttctatttttattttttcatgaaaattattggtgggccactgaaagtccccacacacaaagcctttattctatataattttataaacacaaattcatgattatctgttttgagagttttaagttttgttttaatgtttaacttttatgtgcatatgatgcttccatgtgttggttactagagtagtaggttaactacagacatactgttttgtttgtacatatttataaatctgtaccacctaacattgaacatcattttatatgaagaacatacatgttgcaaaatgactgctttcagcatctaacaggacttctgtaaataataggttaaaagttaaaaataaaacactaatgttttaagagctttagtattttgcttagcattcaatactagcagattcataactgatgcctgttcaaaaacactgttggtggaatcttttatttcatgtgtatgtaactactaaatttttcatgactgaagaggttatagcacatattagttagtgctaatattctactgaatataatttaagcaatgggctaaggtccaagaaacatagcaattatatctacaaataatctattaacatgatcttcagaatctctagtttttgttctatagataaagccataagaatcctttcctaccagtttttcctatatcatttagatattatttcctagaaaacaggatgcctgtcactgataagttagagaaaacacccaaattatacttgcactatggaaagacgacatgaatatgttgactgggtactttctactctcatttttgttagcctatgaaaaaaaaaacattttgttaacctatggaaaaagccttggaagagaaaagtagaattcagtatgtatggaggcacagttttgcacagtatgttgcatgcggcaaaaaaaaaaatatgaaatagagtagaagagataaaagtagttttctgtcaaaaactaggagttaagccttcaggtacgttgtggactaggctttccagcaaggtttttgtagctatttgcttgcctgagaaatgaaattgaaaacatacccctgcgtgtctgtccttaacaccaggctaaattctggtggttaaataacttatctgtggttacaagctagtaagtagcagagccaagattttttttaatatagagacaggtgtctcactgtgttgtccaggctggtcttgaactcctggcctcaagtggtcctcctgcctcagcctcccaaagtgtggggattacaggtgcgagctactgctcccagcaagagccaagattttaacctagatctccctaacaccaaagcttttgaaagggttcagctgaagaatttctcaattctctgttttgttttgtttttatttttgttttttgagatgaagtctcactgcactcaggctggagtgcagtggtacgatcttggctcactgcaacctccacctcccgggttcaagcgattctcctgcctcagctcccaagtagctgggactacaggtgcacgccaccacaactggctaatttttgtatttttagtagagatggggtttcgctatgttggccaggctgatctcaaacttctgacctcaggtgatccacccactttgacctcccaaagtgctgggattactagacgtaagccaccacacctggcaattccctgcttttttgacaacataatttaaatgaatttgatttaaatgtttcctgaatatatatacagatagatagatgagtatcaacacttacaagctctacacagtctgtgagtgtagatactacttactcgtaggattgtcttgtgctttggggatttttgttcggagttctatactatcagcccagaaagctatcaatgtccaagtgaagtgagatgatgcatggccacattattgctttgaccctcacatcaagaaatctgaatgatctggaccaggggtcagcaaagtgcagcctacaagctattgcagtcagctgccagtttttacttttttaaatagttgggaaaaaaattccaaagactgatattttgtgtcacatgaaaattatatgaaattcaaattgcagtgtccataagtaaagttttattggggcacacccatgctcacccttttaaatattgtgtatggccgctttgtgctacagtagcagagttgagtcattgcaagggagaccatatggcccaggtagcctaaaatatttatctgatcctttacagaaaaagtttgctaacccttgataacagatactctaaaatgcaggtttttcttcttcaatttagctcagtggtaggtcaaattgtttgcttttgctattaagcttatgatttggaaacgtaaaatttcatggtggatattataatcagaactattcaaaagggaaaacatgccagccattttatatgatgaagtctcttattccatagaaaactgtagaaagatatctgtatctttggagaaggagaaagaaaggaaagaactccagaatcccatcactgttctttaaagcatgcatcacagacctttaagagtatgctttattgagtaaaggttatagtttgactttaagataagaaattttctagaatcatgtttgaattctaaacgttgatattcttaagtaccatttctgattaggaattaggtgttaaaagaatcatggtaaggaaaccttaatccgttgaaactcttgtaatttggacaacaaaaaactagaaataacactcttttctttgaagatctgattcaaatacaccttagaagagtttaaaatctcccaggcctttaggatgcaataggatattatgccttggtttgactccttttcattcaaattaatgtaagtatgttgttcaagactttgaagcattgaacaatgttctcgatgaattttatttaattactgacattttgtgatatttgaatgttattaagttaaacacttagagttgagtatattcaggggagaaaagtgaatgaaatgactcataataagaaagcttgctcccttgggacagttaccttcctggtgtcattgccatcctgggttgacaagctgagagtagaggatacaagtgatgtgaataaaatggaaattgcattgagttaatgaaacagacacttttagatcaagaaaacacttcaacagcctttttagaaattggcacactcctatagtcccacctactcaagaggctgaggcaggaggatcactagagtacaggagtttggggctgtagtgtgtaatgatcacacctgtgaaagaataaccactgcactccaacctgggcaacatggcaagaccctgtctctttaaaaaaaaaaaaaatcctgggaaaagaagtcaaagatgtaattttacacaatttctgcccccaccgtcttttttgtttgtttgtttgtttgtttgttttttggctagatactaggtattcagtgtttgctgagatgacaggtttctactaatcagccagttatttgggaaggagaaaaactttttctcaattctgaacatgatgcagcttgttaactctccagatagtgcctttgattgaaaataaggtctacacctttttaagtatattatttctgacatcgtaagaaataatttagttccttattctcatttatcttttatataatgtactgtaatattcaggtttaaagtaaaataagtatatgaattatattttggtaaaactgtttcatgaccagcttgattaatgtatattaacataccagacattgacagcgaacatttcatgaaatcagttatttacttaccaaaacaatgagttttagcttgaaagttactgctgctctattattaacaaaactaagttttaaaaattaattttaattctactgaagtttaatttctggttaaaggtatagtggatgctatttatgatccaagtttttacatcacatccattgatctgcctatcccttctttttactccaaagaggagatgatagaataatacattcagtatactaccaagaagcaaagttataatgtgtttcattttgctattggaattttttattgtaacattgtatgataacctgaaatgtttacttgtgccttttctttaaacaattaaagttttccattttataagaa

SEQ ID NO: 129007 - DNA, 7436 bp, Homo sapiens
  Payload ID: 5232
  Gene Symbol: EVI5
  Gene Name: ecotropic viral integration site 5
  Uniprot ID: O60447
  ENST ID: ENST00000540033
  CDS Start-End: 11-2476
tctgcttatcatggttaccaacaaaatgactgctgcctttagaaaccctagtgggaaacaggtggcgacagacaaagttgcagaaaagctgagctctactctctcatgggtgaagaacacagtatcgcatacagtcagtcagatggccagtcaggtggcaagtccatctacttcattacataccacatcctcatctaccacactatcaacaccagccctttcaccatcttccccatcacagttgagtccagacgacttagaactcctggctaaactggaagaacagaatagattgttagaaacggatagtaagtctttaagatctgtaaatgggtcaagaagaaacagtggctcttctcttgtgtcgagttcatcagcctctagcaacctcagtcaccttgaagaagattcttggattctttggggaagaattgttaatgaatgggaagatgtacgcaaaaagaaggaaaagcaagttaaggaacttgttcataaagggataccccatcactttagagcaatagtttggcaacttttatgcagtgcacaaagtatgccaattaaggatcagtattcagaactcctgaaaatgacctcgccttgtgaaaaattgatccgaagggacattgctagaacttaccctgaacacaacttttttaaggaaaaagatagccttggacaggaggttttatttaatgtaatgaaggcttactctttagtagatcgtgaggttggttactgtcaaggaagtgcttttatagttggattgttgcttatgcagatgccagaagaagaagctttctgtgtatttgttaaattaatgcaagattatagacttcgtgaactttttaaaccaagtatggcagaattgggcctttgtatgtaccagtttgaatgtatgatacaggagcatcttccagagctctttgtacattttcaatctcagagttttcatacctcaatgtatgcatcatcctggtttctgactatctttcttacaacttttccactaccaattgcaacaaggatatttgatatctttatgtctgagggtttagaaatagtgtttcgtgtaggattagcacttcttcagatgaatcaggcagaactgatgcaacttgacatggaagggatgttacagcactttcaaaaggtcattccacatcagtttgatggtgtcccagacaagctaatccaagcagcttaccaagtcaaatacaattcaaaaaaaatgaaaaagcttgaaaaggaatacactacaataaaaacgaaagaaatggaagagcaagttgaaattaaaaggttacgcacagaaaatagacttttaaaacagcgcatcgagacattagaaaaagaaagtgcttccttggcagatagattgatacagcataaatgcagttccaactacaacgaagattttgtgctacagctagagaaggaattggtccaagcccgactgagtgaagctgagtctcagtgtgcattaaaagagatgcaggataaagtcttggatatagagaagaggaataactcccttcctgatgagaataatattgcaaggcttcaggaagaactcattgctgtgaaacttagagaagcagaagccattatgggtttgaaagaacttagacagcaagtcaaggatttagaggaacactggcagcgccacttagctcgtactactgggagatggaaagacccacccaagaaaaatgctatgaatgagttacaagatgaactgatgaccattcgacttagagaagctgaaacacaagcagaaataagagaaataaaacaaaggatgatggaaatggaaacacagaaccagatcaatagtaaccatcttcgaagagcagaacaagaggtgattagcctacaggagaaagtgcagtatctttctgcacagaacaaaggactccttactcaattaagtgaagcaaagcgtaaacaagcagagattgaatgcaagaataaggaagaagtgatggctgtgaggcttcgggaagcagatagcatagctgctgtggctgaactacgacaacacattgctgagcttgaaatccagaaagaagaaggaaagcttcaaggacagcttaacaagtctgattctaaccagtatattggggaactgaaagatcagatagcagagctgaatcatgagctcaggtgcctaaaaggccagaggggcttctcaggccaacctccttttgatggaatccacattgtcaaccatttaataggagatgatgaatcattccattcctccgatgaagattttatagataattccttacaggaaactggtgttggttttcctttgcacggaaaatctggttcgatgtctttggaccccgcagtggcagatggtagtgagagcgaaacagaagacagtgtgctggagaccagagagagcaaccaagtggttcaaaaggagcggcccccgagaagaagagagtcgtattcaaccactgtctgaccatcactgtgacctagactatggatttatttaagggatcagttatcatatgattagggctttttggaaataatttgtttcatatgtacatatatatatatatatatatatatatatatatatatatatatatatatatatatattttacagtcttatctgcctttttatctttgccaaatctttaccactgatttaccattgccataaagtagactggtatatggttaatgtgtaaaacaaggttctaacagtattactgaatattaatgtttcttgtttagaaaatgcaactatatctatatgtgggaaccattctgaagttcaaaactatggaaaattgaattttcttcagacaaaactgctcttgtgcaatattttatgctcagtgagcaaattgtgtatttatgtttatcaatttgttctcaaggtggctgtctacagacatttgaccaagacatacatctgatttaccttgtgtttttttttttattgttgtttttttttttaagacagagattcagtctgtcacccaggctggagtgctgtggtgtgatcttagctcactgcaacctccgcctcccaggttcaagcaattttcctgcctcagcctcccgagtacctgggactatatgtgcgcaccaccacgcctggctaattttttgtatttttagtagagatggggtttcaccatgttggctgggctggtctcgaactcctaacctcaagtgatccacccgcctcagcctcccaaagtgctgggattacaggtgtgagccactgcacccagcctaccttgtctgtttgtgtctgggaggttttttttttctatttttattttttcatgaaaattattggtgggccactgaaagtccccacacacaaagcctttattctatataattttataaacacaaattcatgattatctgttttgagagttttaagttttgttttaatgtttaacttttatgtgcatatgatgcttccatgtgttggttactagagtagtaggttaactacagacatactgttttgtttgtacatatttataaatctgtaccacctaacattgaacatcattttatatgaagaacatacatgttgcaaaatgactgctttcagcatctaacaggacttctgtaaataataggttaaaagttaaaaataaaacactaatgttttaagagctttagtattttgcttagcattcaatactagcagattcataactgatgcctgttcaaaaacactgttggtggaatcttttatttcatgtgtatgtaactactaaatttttcatgactgaagaggttatagcacatattagttagtgctaatattctactgaatataatttaagcaatgggctaaggtccaagaaacatagcaattatatctacaaataatctattaacatgatcttcagaatctctagtttttgttctatagataaagccataagaatcctttcctaccagtttttcctatatcatttagatattatttcctagaaaacaggatgcctgtcactgataagttagagaaaacacccaaattatacttgcactatggaaagacgacatgaatatgttgactgggtactttctactctcatttttgttagcctatgaaaaaaaaaacattttgttaacctatggaaaaagccttggaagagaaaagtagaattcagtatgtatggaggcacagttttgcacagtatgttgcatgcggcaaaaaaaaaaatatgaaatagagtagaagagataaaagtagttttctgtcaaaaactaggagttaagccttcaggtacgttgtggactaggctttccagcaaggtttttgtagctatttgcttgcctgagaaatgaaattgaaaacatacccctgcgtgtctgtccttaacaccaggctaaattctggtggttaaataacttatctgtggttacaagctagtaagtagcagagccaagattttttttaatatagagacaggtgtctcactgtgttgtccaggctggtcttgaactcctggcctcaagtggtcctcctgcctcagcctcccaaagtgtggggattacaggtgcgagctactgctcccagcaagagccaagattttaacctagatctccctaacaccaaagcttttgaaagggttcagctgaagaatttctcaattctctgttttgttttgtttttatttttgttttttgagatgaagtctcactgcactcaggctggagtgcagtggtacgatcttggctcactgcaacctccacctcccgggttcaagcgattctcctgcctcagctcccaagtagctgggactacaggtgcacgccaccacaactggctaatttttgtatttttagtagagatggggtttcgctatgttggccaggctgatctcaaacttctgacctcaggtgatccacccactttgacctcccaaagtgctgggattactagacgtaagccaccacacctggcaattccctgcttttttgacaacataatttaaatgaatttgatttaaatgtttcctgaatatatatacagatagatagatgagtatcaacacttacaagctctacacagtctgtgagtgtagatactacttactcgtaggattgtcttgtgctttggggatttttgttcggagttctatactatcagcccagaaagctatcaatgtccaagtgaagtgagatgatgcatggccacattattgctttgaccctcacatcaagaaatctgaatgatctggaccaggggtcagcaaagtgcagcctacaagctattgcagtcagctgccagtttttacttttttaaatagttgggaaaaaaattccaaagactgatattttgtgtcacatgaaaattatatgaaattcaaattgcagtgtccataagtaaagttttattggggcacacccatgctcacccttttaaatattgtgtatggccgctttgtgctacagtagcagagttgagtcattgcaagggagaccatatggcccaggtagcctaaaatatttatctgatcctttacagaaaaagtttgctaacccttgataacagatactctaaaatgcaggtttttcttcttcaatttagctcagtggtaggtcaaattgtttgcttttgctattaagcttatgatttggaaacgtaaaatttcatggtggatattataatcagaactattcaaaagggaaaacatgccagccattttatatgatgaagtctcttattccatagaaaactgtagaaagatatctgtatctttggagaaggagaaagaaaggaaagaactccagaatcccatcactgttctttaaagcatgcatcacagacctttaagagtatgctttattgagtaaaggttatagtttgactttaagataagaaattttctagaatcatgtttgaattctaaacgttgatattcttaagtaccatttctgattaggaattaggtgttaaaagaatcatggtaaggaaaccttaatccgttgaaactcttgtaatttggacaacaaaaaactagaaataacactcttttctttgaagatctgattcaaatacaccttagaagagtttaaaatctcccaggcctttaggatgcaataggatattatgccttggtttgactccttttcattcaaattaatgtaagtatgttgttcaagactttgaagcattgaacaatgttctcgatgaattttatttaattactgacattttgtgatatttgaatgttattaagttaaacacttagagttgagtatattcaggggagaaaagtgaatgaaatgactcataataagaaagcttgctcccttgggacagttaccttcctggtgtcattgccatcctgggttgacaagctgagagtagaggatacaagtgatgtgaataaaatggaaattgcattgagttaatgaaacagacacttttagatcaagaaaacacttcaacagcctttttagaaattggcacactcctatagtcccacctactcaagaggctgaggcaggaggatcactagagtacaggagtttggggctgtagtgtgtaatgatcacacctgtgaaagaataaccactgcactccaacctgggcaacatggcaagaccctgtctctttaaaaaaaaaaaaaatcctgggaaaagaagtcaaagatgtaattttacacaatttctgcccccaccgtcttttttgtttgtttgtttgtttgtttgttttttggctagatactaggtattcagtgtttgctgagatgacaggtttctactaatcagccagttatttgggaaggagaaaaactttttctcaattctgaacatgatgcagcttgttaactctccagatagtgcctttgattgaaaataaggtctacacctttttaagtatattatttctgacatcgtaagaaataatttagttccttattctcatttatcttttatataatgtactgtaatattcaggtttaaagtaaaataagtatatgaattatattttggtaaaactgtttcatgaccagcttgattaatgtatattaacataccagacattgacagcgaacatttcatgaaatcagttatttacttaccaaaacaatgagttttagcttgaaagttactgctgctctattattaacaaaactaagttttaaaaattaattttaattctactgaagtttaatttctggttaaaggtatagtggatgctatttatgatccaagtttttacatcacatccattgatctgcctatcccttctttttactccaaagaggagatgatagaataatacattcagtatactaccaagaagcaaagttataatgtgtttcattttgctattggaattttttattgtaacattgtatgataacctgaaatgtttacttgtgccttttctttaaacaattaaagttttccattttataagaa

SEQ ID NO: 129008 - DNA, 3855 bp, Homo sapiens
  Payload ID: 5233
  Gene Symbol: EVI5L
  Gene Name: ecotropic viral integration site 5-like
  Uniprot ID: Q96CN4
  ENST ID: ENST00000270530
  CDS Start-End: 197-2581
ggcagcggcggagccggcggcggccgcggtcccggggggcggctgagggggccgggccggggctgcggggcgaacggcgcggctaggatccggcggctcagcccggggcggcgaggctcggcacggagatggcggcgcgctcggcgcagacagagctgtgaaccaaccccgctcacggctaacaagcccacccaccatggcgagccccactctgagccccgactcctcatcccaggaggccctgtcggcccccacctgctccccaacctctgactccgagaacctcagccccgatgagctggagctgctggccaagctcgaagagcagaaccggctcctggaggccgactccaagtccatgcgctccatgaatggctcgcggcggaacagtggctcctcgctagtgtccagctcctcggcctcctccaacctgagccacctggaggaggacacgtggatcctgtggggccggatcgccaacgagtgggaggagtggcggcgcaggaaggagaagctgctcaaggagctgatccgcaagggcatcccccaccacttccgggccatcgtgtggcagcttctgtgcagcgccacggacatgcccgtcaagaaccagtactccgagctgctcaagatgtcctcgccgtgcgagaagctgatccgcagggacatcgcccgcacctacccggaacatgagttcttcaagggccaggacagcctgggccaggaggtcctcttcaacgtcatgaaggcatactcgctggtagaccgggaggtgggctactgccagggaagcgccttcatcgtgggcctgctcctcatgcagatgcctgaggaggaggccttctgtgtgttcgtgcggctgatgcaggagtaccggctgcgggagctcttcaaacccagcatggccgagctcgggctctgcatctatcagttcgagtacatgctgcaggagcagctcccagacctcaacacccacttccgttcccaaagcttccacacatccatgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcagagctgatgcagctggacatggaggggatgtcccagtacttccagagagtgatcccccaccagttcgacagctgcccggacaagctggtcctcaaagcctaccaggtcaagtacaaccccaagaagatgaagaggctggagaaggagtacgcagccatgaagagcaaggagatggaggagcagatcgagatcaaaagacttcggacggagaaccggctcctgaaacagcggattgaaaccctagagaaggggcaagtgacacgggcgcaggaggcggaggagaactacgtcatcaagcgggagctggcggtggtgcggcagcagtgcagctcggcggccgaggacctgcagaaggcacagagcaccatccggcagctacaggagcagcaggagaacccccgcctcacagaagacttcgtgtcccacctggagaccgagctggagcagtcgaggctgcgggagacggagacactgggggcccttcgggagatgcaggacaaggttctcgacatggaaaagaggaacagctcgctgcccgacgagaacaatgtggcgcagctgcaggaggagctgaaggcgctcaaggtgcgggaaggccaggcggtggcctcgacgcgagagcttaaactgcagctgcaggagctctcggacacctggcaggcccatctggcccgcggcggccgctggaaggagtccccacggaagctggtcgtgggcgagctgcaggacgagctgatgagcgtgcgtctgcgcgaggcccaggccctggccgagggccgcgagctgcggcagcgcgtggtggaacttgagacgcaggaccacatccaccgcaaccttctgaaccgcgtggaggcggagcgcgcggcgctgcaggagaagctgcagtacctggctgcacagaacaaggggctgcagacgcagctcagcgaaagccgccgcaagcaggccgaggccgagtgcaagagcaaggaggaggtgatggctgtgcgactgcgggaggcggacagcatggctgcggtggccgagatgcggcagcgcattgccgagctggagatccagagggaggaaggccgcatccagggccagctgaaccactcggactcatcgcagtacatccgcgagctcaaggaccagatcgaggagctgaaggccgaggtgcggctgctgaagggcccgccgcccttcgaggacccgctggctttcgatgggctgagcctggcgcggcacttggacgaggactcgctgccgtcgtcggacgaggagctacttggcgtaggcgtgggcgctgccctgcaggacgcattgtaccctctgtccccgcgcgatgcgcgcttcttccgccgtctggagcggccggccaaggacagcgagggcagctcagacagcgacgccgatgagctggccgcgccctacagccagggtctggacaactgaggccatgcccagcgcgcccggagtcaggaggccgcagccgcggggggcgcccgggcagtccgcgttctgctccccacctgccgcacttgacaaactacgcgccctctgtggctcggccacccctaaagcgaggcccggcgaggcagcgcagagggtagggtccgacctgggctcctcagggccccggggcaggctctctatccccagcagtgtttacccatcttggtctgtacccctccgggccctctggcgttccaggggtgcctggaggggctgactgctctcttaacaggagggcagagggcaggggacagacgacccagaggtcccagcactgaatgagcaggcagctcccacctcctggcaggcttccttctgggacaggggcgacattgctgggaagtgctcaggaggtagccgaggcctgaggaaggagagcgccagctctgggctggacatcagcaccccacaacactcctcgggatgaagtgacccttgactagcccctggccatctctaggggagtcaggccgctggggacagatggccaggccggcctctcctgcctggcgcaggcaccgtggcccctgcagcggaaaccaaagtccccctactatgtgcggggcgcctggggactgagtggctaacgggaagcctccctgcttctctggggccagagcagcttccaggaagtgaagagacccctctccccagtgccccacatctttctctgggagacactcgcgccccctatcctggccagtgatggaggggtatctctacaggggtcctcggtctccatctacttccctttcttcatgtgtttccagccccaccctcagccagagccaggcccccaggcaggagcttcccagcgagcggcctcccctcacttcctcctggtggtcccgttgtctctgctgaatcagagctgagaacggtgccaaaatccaacgatgccccccaggccccttcctcccttcccccggccccccgggcctcatgaccctgggggctgcccccctcggtgctcccggagcctccagtagagtagcgtcacaagcaatctccctggcgcttcctgggtggggacccctgctccgtccccgcttcctagctgcccacttttcagtgttacgaagcctggggaccggggcaggcacccacggggctctccacacgccccctacactgcccgccaccattttgcacactgcctgttcacatgtcgcccaggcgggaaaaatggaaaataaagtgtatttacacagtca

SEQ ID NO: 129009 - DNA, 2418 bp, Homo sapiens
  Payload ID: 5233
  Gene Symbol: EVI5L
  Gene Name: ecotropic viral integration site 5-like
  Uniprot ID: Q96CN4
  ENST ID: ENST00000538904
  CDS Start-End: 1-2418
atggcgagccccactctgagccccgactcctcatcccaggaggccctgtcggcccccacctgctccccaacctctgactccgagaacctcagccccgatgagctggagctgctggccaagctcgaagagcagaaccggctcctggaggccgactccaagtccatgcgctccatgaatggctcgcggcggaacagtggctcctcgctagtgtccagctcctcggcctcctccaacctgagccacctggaggaggacacgtggatcctgtggggccggatcgccaacgagtgggaggagtggcggcgcaggaaggagaagctgctcaaggagctgatccgcaagggcatcccccaccacttccgggccatcgtgtggcagcttctgtgcagcgccacggacatgcccgtcaagaaccagtactccgagctgctcaagatgtcctcgccgtgcgagaagctgatccgcagggacatcgcccgcacctacccggaacatgagttcttcaagggccaggacagcctgggccaggaggtcctcttcaacgtcatgaaggcatactcgctggtagaccgggaggtgggctactgccagggaagcgccttcatcgtgggcctgctcctcatgcagatgcctgaggaggaggccttctgtgtgttcgtgcggctgatgcaggagtaccggctgcgggagctcttcaaacccagcatggccgagctcgggctctgcatctatcagttcgagtacatgctgcaggagcagctcccagacctcaacacccacttccgttcccaaagcttccacacatccatgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcagagctgatgcagctggacatggaggggatgtcccagtacttccagagagtgatcccccaccagttcgacagctgcccggacaagctggtcctcaaagcctaccaggtcaagtacaaccccaagaagatgaagaggctggagaaggagtacgcagccatgaagagcaaggagatggaggagcagatcgagatcaaaagacttcggacggagaaccggctcctgaaacagcggattgaaaccctagagaaggagagcgctgctctggctgataggttaatccaggggcaagtgacacgggcgcaggaggcggaggagaactacgtcatcaagcgggagctggcggtggtgcggcagcagtgcagctcggcggccgaggacctgcagaaggcacagagcaccatccggcagctacaggagcagcaggagaacccccgcctcacagaagacttcgtgtcccacctggagaccgagctggagcagtcgaggctgcgggagacggagacactgggggcccttcgggagatgcaggacaaggttctcgacatggaaaagaggaacagctcgctgcccgacgagaacaatgtggcgcagctgcaggaggagctgaaggcgctcaaggtgcgggaaggccaggcggtggcctcgacgcgagagcttaaactgcagctgcaggagctctcggacacctggcaggcccatctggcccgcggcggccgctggaaggagtccccacggaagctggtcgtgggcgagctgcaggacgagctgatgagcgtgcgtctgcgcgaggcccaggccctggccgagggccgcgagctgcggcagcgcgtggtggaacttgagacgcaggaccacatccaccgcaaccttctgaaccgcgtggaggcggagcgcgcggcgctgcaggagaagctgcagtacctggctgcacagaacaaggggctgcagacgcagctcagcgaaagccgccgcaagcaggccgaggccgagtgcaagagcaaggaggaggtgatggctgtgcgactgcgggaggcggacagcatggctgcggtggccgagatgcggcagcgcattgccgagctggagatccagagggaggaaggccgcatccagggccagctgaaccactcggactcatcgcagtacatccgcgagctcaaggaccagatcgaggagctgaaggccgaggtgcggctgctgaagggcccgccgcccttcgaggacccgctggctttcgatgggctgagcctggcgcggcacttggacgaggactcgctgccgtcgtcggacgaggagctacttggcgtaggcgtgggcgctgccctgcaggacgcattgtaccctctgtccccgcgcgatgcgcgcttcttccgccgtctggagcggccggccaaggacagcgagggcagctcagacagcgacgccgatgagctggccgcgccctacagccagggtctggacaactga

SEQ ID NO: 129010 - DNA, 417 bp, Homo sapiens
  Payload ID: 5233
  Gene Symbol: EVI5L
  Gene Name: ecotropic viral integration site 5-like
  ENST ID: ENST00000601766
  CDS Start-End: 1-417
ttcgtgtcccacctggagaccgagctggagcagtcgaggctgcgggagacggagacactgggggcccttcgggagatgcaggacaaggttctcgacatggaaaagaggaacagctcgctgcccgacgagaacaatgtggcgcagctgcaggaggagctgaaggcgctcaaggtgcgggaaggccaggcggtggcctcgacgcgagagcttaaactgcagctgcaggagctctcggacacctggcaggaccagatcgaggagctgaaggccgaggtgcggctgctgaagggcccgccgcccttcgaggacccgctggctttcgatgggctgagcctggcgcggcacttggacgaggactcgctgccgtcgtcggacgaggagctacttggcgtaggcgtgggcgctgccctgcaggac

SEQ ID NO: 129011 - DNA, 610 bp, Homo sapiens
  Payload ID: 5233
  Gene Symbol: EVI5L
  Gene Name: ecotropic viral integration site 5-like
  ENST ID: ENST00000599036
  CDS Start-End: 1-534
gtgttcgtgcggctgatgcaggagtaccggctgcgggagctcttcaaacccagcatggccgagctcgggctctgcatctatcagttcgagtacatgctgcaggagcagctcccagacctcaacacccacttccgttcccaaagcttccacacatccatgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcagagctgatgcagctggacatggaggggatgtcccagtacttccagagagtgatcccccaccagttcgacagctgcccggacaagctggtcctcaaagcctaccaggtcaagtacaaccccaagaagatgaagaggctggagaaggagtacgcagccatgaagagcaaggagatggaggagcagatcgagatcaaagccagctgtgagcgcctcccccgcctgacgccgcggtaaccaagacagtcaaggtccctgccccgctgggccgcccagcgtcatggggaagcaatcaataaaccactgaactaga

SEQ ID NO: 129012 - DNA, 1501 bp, Homo sapiens
  Payload ID: 5234
  Gene Symbol: ECSIT
  Gene Name: ECSIT signalling integrator
  Uniprot ID: Q9BQ95
  ENST ID: ENST00000252440
  CDS Start-End: 100-990
gctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgca

SEQ ID NO: 129013 - DNA, 1700 bp, Homo sapiens
  Payload ID: 5234
  Gene Symbol: ECSIT
  Gene Name: ECSIT signalling integrator
  Uniprot ID: Q9BQ95
  ENST ID: ENST00000270517
  CDS Start-End: 137-1432
ttgatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcatgcgcagtttcca

SEQ ID NO: 129014 - DNA, 970 bp, Homo sapiens
  Payload ID: 5234
  Gene Symbol: ECSIT
  Gene Name: ECSIT signalling integrator
  Uniprot ID: Q9BQ95
  ENST ID: ENST00000417981
  CDS Start-End: 135-788
gatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccc

SEQ ID NO: 129015 - DNA, 993 bp, Homo sapiens
  Payload ID: 5234
  Gene Symbol: ECSIT
  Gene Name: ECSIT signalling integrator
  ENST ID: ENST00000585318
  CDS Start-End: 324-993
ctgggccaatatggcagcgcccagcaacaagacagagctggcctggagtccgcggctggccgcgtgagtaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtg

SEQ ID NO: 129016 - DNA, 745 bp, Homo sapiens
  Payload ID: 5234
  Gene Symbol: ECSIT
  Gene Name: ECSIT signalling integrator
  ENST ID: ENST00000593231
  CDS Start-End: 1-178
gatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacgcacaggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggtaagtccgagagcatgggggcagccaagtctctaaccttacccaggccctgccaggttctcgctgggcctaggctgggctccctgggcctctgggccgagtcccttgcagggcacagggcatgtatgtctccacaccaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggt

SEQ ID NO: 129017 - DNA, 941 bp, Homo sapiens
  Payload ID: 5234
  Gene Symbol: ECSIT
  Gene Name: ECSIT signalling integrator
  ENST ID: ENST00000592571
  CDS Start-End: 1-215
acgtcaaccccttcccagtgccccgggacctgccccaggaccctgtggagctggccatgtttggcctgcggcacatggagcctgaccttagtgccagggtcaccatctaccaggccccgtgcgctgcccctgacgccgcccgtctccctccccagaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaa

SEQ ID NO: 129018 - DNA, 642 bp, Homo sapiens
  Payload ID: 5234
  Gene Symbol: ECSIT
  Gene Name: ECSIT signalling integrator
  ENST ID: ENST00000592665
  CDS Start-End: 336-642
ggcaaccgggcaggatttggaatccgcgtctgcctttttcccccaagagacccagaatcctggcagccggtttcaaagctgttgtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacc

SEQ ID NO: 129019 - DNA, 258 bp, Homo sapiens
  Payload ID: 5234
  Gene Symbol: ECSIT
  Gene Name: ECSIT signalling integrator
  ENST ID: ENST00000586149
  CDS Start-End: 185-258
agagctggcctggagtccgcggctggccgcgtgagtagatggagttttgctgttgttccccaggctgaggtgtaatggcatcatcttggctcactgcaacctctgcctcctgggttcaagcaattctcctacgtcagccttcccagtagctggaattacaggtgattgtctgacaagcagaggcatgagctgggtccaggccaccctactggcccgaggcctctgtagggcctggggaggcacctgcggggccgccct

SEQ ID NO: 129020 - DNA, 1319 bp, Homo sapiens
  Payload ID: 5234
  Gene Symbol: ECSIT
  Gene Name: ECSIT signalling integrator
  Uniprot ID: Q9BQ95
  ENST ID: ENST00000591104
  CDS Start-End: 145-1035
ttttgcagatgacctcgcgagaggtcacgccgcaagtcggcaaccgggcaggatttggaatccgcgtctgcctttttcccccaagagacccagaatcctggcagccggtttcaaagctgttgtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctag

SEQ ID NO: 129021 - DNA, 1286 bp, Homo sapiens
  Payload ID: 5234
  Gene Symbol: ECSIT
  Gene Name: ECSIT signalling integrator
  ENST ID: ENST00000592312
  CDS Start-End: 316-1119
atatggcagcgcccagcaacaagacagagctggcctggagtccgcggctggccgcgtgagtaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggtaagtccgagagcatgggggcagccaagtctctaaccttacccaggccctgccaggttctcgctgggcctaggctgggctccctgggcctctgggccgagtcccttgcagggcacagggcatgtatgtctccacaccaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctc

SEQ ID NO: 129022 - DNA, 873 bp, Homo sapiens
  Payload ID: 5234
  Gene Symbol: ECSIT
  Gene Name: ECSIT signalling integrator
  ENST ID: ENST00000590480
  CDS Start-End: 191-873
gggccaatatggcagcgcccagcaacaagacagagctggcctggagtccgcggctggccgcgtgagtagtagagacagggtttctccatgttggtcaggctggtctcgaactcccgacctcaggtgatcagctggcctggacctcccaacgtgctgggattacacacgtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccat

SEQ ID NO: 129023 - DNA, 818 bp, Homo sapiens
  Payload ID: 5234
  Gene Symbol: ECSIT
  Gene Name: ECSIT signalling integrator
  ENST ID: ENST00000588998
  CDS Start-End: 59-307
gctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggttcctttgcccaaagactcaacaggtgcagcagatcccccccagccccacatcgtaggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgca

SEQ ID NO: 129024 - DNA, 5520 bp, Homo sapiens
  Payload ID: 5235
  Gene Symbol: ENC1
  Gene Name: ectodermal-neural cortex 1 (with BTB domain)
  Uniprot ID: O14682
  ENST ID: ENST00000302351
  CDS Start-End: 1132-2901
agagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgagtggaaacaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcaaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcagataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttcatta

SEQ ID NO: 129025 - DNA, 1405 bp, Homo sapiens
  Payload ID: 5235
  Gene Symbol: ENC1
  Gene Name: ectodermal-neural cortex 1 (with BTB domain)
  ENST ID: ENST00000508331
  CDS Start-End: 1257-1405
agagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctctggttttccaagaattgatataaagcgggaagaacagaaaacagcagtcataagtatgctactcaaaatattcttctttttatgtgccaaatcctcacattggaagctgtcccgagcaagacaggagtggaaacaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttct

SEQ ID NO: 129026 - DNA, 5381 bp, Homo sapiens
  Payload ID: 5235
  Gene Symbol: ENC1
  Gene Name: ectodermal-neural cortex 1 (with BTB domain)
  Uniprot ID: O14682
  ENST ID: ENST00000510316
  CDS Start-End: 1215-2765
agagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcaaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcagataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttca

SEQ ID NO: 129027 - DNA, 584 bp, Homo sapiens
  Payload ID: 5235
  Gene Symbol: ENC1
  Gene Name: ectodermal-neural cortex 1 (with BTB domain)
  ENST ID: ENST00000509127
  CDS Start-End: 573-584
gcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgtgtcagcatttgcaggtatacaggaacagtcctagtgatgcactatttaatcaaaagacggatggatcttttgttcttgcagctggttttccaagaattgatataaagcgggaagaacagaaaacagcagtcataagagtggaaacaaaatgtcagtcagt

SEQ ID NO: 129028 - DNA, 2024 bp, Homo sapiens
  Payload ID: 5235
  Gene Symbol: ENC1
  Gene Name: ectodermal-neural cortex 1 (with BTB domain)
  Uniprot ID: O14682
  ENST ID: ENST00000537006
  CDS Start-End: 159-1928
cggcacacaaggcgctttctagctggccctcctttctccggggcattcgccaccgcttccctgggctgagacgaccggttcgtcgcctccttgcccgtgaccgtcgctagaactcagttgtgcgttgcggccagtcgccactgctgagtggaaacaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcaaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaag

SEQ ID NO: 129029 - DNA, 5657 bp, Homo sapiens
  Payload ID: 5235
  Gene Symbol: ENC1
  Gene Name: ectodermal-neural cortex 1 (with BTB domain)
  Uniprot ID: O14682
  ENST ID: ENST00000618628
  CDS Start-End: 1269-3038
agagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgtgtcagcatttgcaggtatacaggaacagtcctagtgatgcactatttaatcaaaagacggatggatcttttgttcttgcagctggttttccaagaattgatataaagcgggaagaacagaaaacagcagtcataagagtggaaacaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcaaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcagataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttcatta

SEQ ID NO: 129030 - DNA, 1233 bp, Homo sapiens
  Payload ID: 5236
  Gene Symbol: EDA
  Gene Name: ectodysplasin A
  Uniprot ID: Q92838
  ENST ID: ENST00000338901
  CDS Start-End: 243-686
attccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggtgagtcacctagtaggggcggcggcggccccctcccctcgcgggtagggcgagggccctccgccacaggggcctgggagcactcagcaacctcgagccaatttagagggcaggaccagggagggaccaggcgagcaagggagaagttgcccagggcaggttgtcttcggtccctggcccagctaatccagactccctggggaccccttgacttggaaagtctcgcgcgcgcccgcggcccctggctgcgggctgcctcgagaaaagttggcgacgctcccgtcgaggaggtgcctgcgctgccccccggccgactaacggcttggcccttctgctcgtgatgaggttctctgcccgcggtgcttgttttttcgtgtctagagctgatgccagaaccagcaggctcccctttggagttggagctgtaaacagctgtaataactgttccacgcccgcccgttgaaacaacttttaaccgcattttcagcgcgggtccttgtgcgctgaccagaacgtgggcttgttcacacttacctgcaatttgagactgattgtcctcggcgttctagtgaggatcagcgcccctgaggaattc

SEQ ID NO: 129031 - DNA, 5278 bp, Homo sapiens
  Payload ID: 5236
  Gene Symbol: EDA
  Gene Name: ectodysplasin A
  Uniprot ID: Q92838
  ENST ID: ENST00000374552
  CDS Start-End: 243-1418
attccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccagatggccctattgaatttcttcttccctgatgaaaagccatactctgaagaagaaagtaggcgtgttcgccgcaataaaagaagcaaaagcaatgaaggagcagatggcccagttaaaaacaagaaaaagggaaagaaagcaggacctcctggacccaatggccctccaggacccccaggacctccaggaccccagggacccccaggaattccagggattcctggaattccaggaacaactgttatgggaccacctggtcctccaggtcctcctggtcctcaaggaccccctggcctccagggaccttctggtgctgctgataaagctggaactcgagaaaaccagccagctgtggtgcatctacagggccaagggtcagcaattcaagtcaagaatgatctttcaggtggagtgctcaatgactggtctcgcatcactatgaaccccaaggtgtttaagctacatccccgcagcggggagctggaggtactggtggacggcacctacttcatctatagtcaggtagaagtatactacatcaacttcactgactttgccagctatgaggtggtggtggatgagaagcccttcctgcagtgcacacgcagcatcgagacgggcaagaccaactacaacacttgctataccgcaggcgtctgcctcctcaaggcccggcagaagatcgccgtcaagatggtgcacgctgacatctccatcaacatgagcaagcacaccacgttctttggggccatcaggctgggtgaagcccctgcatcctagattccccccattttgcctctgtccgtgccccttccctgggtttgggagccaggactcccagaacctctaagtgctgctgtggagtgaggtgtattggtgttgcagccgcagagaaatgccccagtgttatttattccccagtgactccagggtgacaaggcctgcttgactttccagaatgaccttgagttaacaggacagttgatggagccccagggtttacatgaagcagaaccttctttggttccatgttgactgacttatggcatgactcttcaaccccgaggtccctgttgtcagatctattgtttgttgcactaaaatgaggatccagggcagcaggccagagaaagcaaaggtgcactccagactctgggggtggacatctgaccccaagggggctgctgctcctctcttgggtagggtagtggctggggtggagtgggaagggagcattgcagcctaagaagaaggccagagagggaaaaggcaggtgcttttggcagagaccataagagaaacctgccaaggagcatccttggcagtgggaatgttctttctgctctatactgtggcctgcaggagggttggagtgctcttcccactccagctgacagccacaccgtggcagcttgctgggctttgggaagtttgctgtgctttggaacaatcacagggaatggccacaaacctgcccgcctaagaccctgaatccgtacttgggtcacatgactctcattttatttacagctgtgctccacactcagaaaattccctggggtcaccttctagttgcccccattcccagcctgactagaactcctgtcttctttctccatggagcctacctctgtctgagacaggtgcctaacctgggacctgtggtcatgtgagtctgggatattctttagcttacctgggcacaaacagaattttccatttattaagcagtacaaatgtttttcatccattcctaatcaaattctgtctggggacgaagggttggacgggatgacctccagaagtcccttcaatttctagtacctgtgactcttagccctcaccacagccttctaaattcccaaatcctagactgctcctgggcattagcaaggcagagcctttttacctggcctagaaagggcaaggggtgaggataggacagagggattttgttcaagtttgctgcaacccaagtggacgttaggccaggccttatctgaaaggccagcagctgatgctgtactaacccagtctttcttcactctggcttcaaaaagccacagcagagcattgtcaccgcaggtgctcatgctgctcccctaaagccaggctcaggagaagccagtgtctaggcactgagcagggatctgccccctagttcaggtccaaattcaccttcccctaaaccccaagcttcccaacagatcatatggtaggaccctcgagagccttacttcaaagtgcctgggctcagcctggtttctgggtgctagatccagcccaaacctgggaaggccagccttgtacagtctgctcctcttgttcctgaaatgtgtttccttttcaggagatggggaataatttccttcaggcagctgaaattcaccaagaacagcgggtacttatttctcagctgtgccttccctttctaagcaaccacactgcttggcccttcaagggtcagggtgagacgtgatgggctaggcctccgttgtctggttgctaatgacagccttgcaacccaaggtgaggtgaactccaggcatgtgtctggccctaactcctataaagtgcctcggacagtccgcagttgtagcagaaaccaacaagaaccactccttcatgtttggaaaataatttctcttgtattatctcctttgaagaaggcaaggctgataatatgacaaacatcattgtttagatgaggctcagagaggtagcactctcagagtgttttgaccagtttaagccgcagacctggagcttcagccaggtctgactccaaagctgttccattacaccacagcattgtgtggaatttgaggtctagagagaaccaataaaagtggtaattgggaactgaaatccttgagagttccggggagaaacccagagatgcctgatttcattcctcgatggtaatacccgtcctctcggctgccaggggctctgtggcaaaaagagtcagacatttctttggaaaacagcgaacagccttagagctcttgtgttcagaagaatcttcctggcacaatgttggagcagcaggcctctgggacccacagaacttgtggcctttatgttctttcacccatcctaggaaccagccaaccatcatgtgtagagcccctactgtgggcaaagtcctcctttcattaccctacagacagcttacaggagccagcctgcttcccacaactactagtgtgactccttatctctttccaccataccttagagactttgatactaccagggtctctcagggatggagggaagacctgaaagagaggactggttctgaggccagaaaggtgtgaggagagaggaggaaaagtcttcctaattgtgcccctaaagagcatcctgataccattctattctccagacatggaggggatgataaaggaaataggatctccactggacccttgattcattctgaaccctccaaaggaactctagagggcgagggatgatgagggaagcaataggtagctggggagccctattgctgctaagtcattggcaaagtgacaaagcaatttactgatgagagaatgtggaaatagatgtgcagtttggaattatgttggtgtgaatttgccagaggaccaatgcttgcatggagaatgggacgaggacatttgtgggcaagcagatgacagaggtttgaaggagaatggcatggcaggagtctctgccagttacttgggcttcaacagccaagctggcacaaaagacagctggcggaggctgctcggctactggttacctggagaagtagtatttgcctatttcccccttcatccatcctgagccaaatttcttttgctgaacaggaaagagctaggaaccctggaggtaaacaaagactttgatccatgtatgagtgtatgtgtttatgtaacttcctgtggatgcaaatagattcagagaaatttagagctaaaaaggcccttagagggaatctagcccaacctacattccaccctgttacttatgtagaaactgaggcccagagagggaagatgacctgccccaagtggtgagcaagcaccaacctccagactcagcagagtgagggggtaaagcagttcctgtcccacatggccatcttctttcttccacccacaaactccaggctggaagtacttggcccccttcaggagcctggccaggcagggagagagtagctgcagccttcatcagaactcttcctcctcccaaggcattctcccagctctagcctctggactggaaagcacaagactggcccagtgccagcaagtccttaggctactgtaatgctgcctcaggacccatccctgcctggaggctcctctaggccctgtgagcacaaagaagaaagctgatttttgtcttttaatccatttcaggactctctccaggagggctcggggtgtgtcatttctatattcctccagctgggattggggggtgggctttgttgtgagaatggcctggagcaggcccaatgctgcttttgggggtcagcatccagtgtgagatactgtgtatataaactatatataatgtatataaactgggatgtaagtttgtgtaaattaatggtttattctttgcaaataaaacgctttccccgtctgttcttg

SEQ ID NO: 129032 - DNA, 5272 bp, Homo sapiens
  Payload ID: 5236
  Gene Symbol: EDA
  Gene Name: ectodysplasin A
  Uniprot ID: Q92838
  ENST ID: ENST00000374553
  CDS Start-End: 243-1412
attccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccagatggccctattgaatttcttcttccctgatgaaaagccatactctgaagaagaaagtaggcgtgttcgccgcaataaaagaagcaaaagcaatgaaggagcagatggcccagttaaaaacaagaaaaagggaaagaaagcaggacctcctggacccaatggccctccaggacccccaggacctccaggaccccagggacccccaggaattccagggattcctggaattccaggaacaactgttatgggaccacctggtcctccaggtcctcctggtcctcaaggaccccctggcctccagggaccttctggtgctgctgataaagctggaactcgagaaaaccagccagctgtggtgcatctacagggccaagggtcagcaattcaagtcaagaatgatctttcaggtggagtgctcaatgactggtctcgcatcactatgaaccccaaggtgtttaagctacatccccgcagcggggagctggaggtactggtggacggcacctacttcatctatagtcaggtatactacatcaacttcactgactttgccagctatgaggtggtggtggatgagaagcccttcctgcagtgcacacgcagcatcgagacgggcaagaccaactacaacacttgctataccgcaggcgtctgcctcctcaaggcccggcagaagatcgccgtcaagatggtgcacgctgacatctccatcaacatgagcaagcacaccacgttctttggggccatcaggctgggtgaagcccctgcatcctagattccccccattttgcctctgtccgtgccccttccctgggtttgggagccaggactcccagaacctctaagtgctgctgtggagtgaggtgtattggtgttgcagccgcagagaaatgccccagtgttatttattccccagtgactccagggtgacaaggcctgcttgactttccagaatgaccttgagttaacaggacagttgatggagccccagggtttacatgaagcagaaccttctttggttccatgttgactgacttatggcatgactcttcaaccccgaggtccctgttgtcagatctattgtttgttgcactaaaatgaggatccagggcagcaggccagagaaagcaaaggtgcactccagactctgggggtggacatctgaccccaagggggctgctgctcctctcttgggtagggtagtggctggggtggagtgggaagggagcattgcagcctaagaagaaggccagagagggaaaaggcaggtgcttttggcagagaccataagagaaacctgccaaggagcatccttggcagtgggaatgttctttctgctctatactgtggcctgcaggagggttggagtgctcttcccactccagctgacagccacaccgtggcagcttgctgggctttgggaagtttgctgtgctttggaacaatcacagggaatggccacaaacctgcccgcctaagaccctgaatccgtacttgggtcacatgactctcattttatttacagctgtgctccacactcagaaaattccctggggtcaccttctagttgcccccattcccagcctgactagaactcctgtcttctttctccatggagcctacctctgtctgagacaggtgcctaacctgggacctgtggtcatgtgagtctgggatattctttagcttacctgggcacaaacagaattttccatttattaagcagtacaaatgtttttcatccattcctaatcaaattctgtctggggacgaagggttggacgggatgacctccagaagtcccttcaatttctagtacctgtgactcttagccctcaccacagccttctaaattcccaaatcctagactgctcctgggcattagcaaggcagagcctttttacctggcctagaaagggcaaggggtgaggataggacagagggattttgttcaagtttgctgcaacccaagtggacgttaggccaggccttatctgaaaggccagcagctgatgctgtactaacccagtctttcttcactctggcttcaaaaagccacagcagagcattgtcaccgcaggtgctcatgctgctcccctaaagccaggctcaggagaagccagtgtctaggcactgagcagggatctgccccctagttcaggtccaaattcaccttcccctaaaccccaagcttcccaacagatcatatggtaggaccctcgagagccttacttcaaagtgcctgggctcagcctggtttctgggtgctagatccagcccaaacctgggaaggccagccttgtacagtctgctcctcttgttcctgaaatgtgtttccttttcaggagatggggaataatttccttcaggcagctgaaattcaccaagaacagcgggtacttatttctcagctgtgccttccctttctaagcaaccacactgcttggcccttcaagggtcagggtgagacgtgatgggctaggcctccgttgtctggttgctaatgacagccttgcaacccaaggtgaggtgaactccaggcatgtgtctggccctaactcctataaagtgcctcggacagtccgcagttgtagcagaaaccaacaagaaccactccttcatgtttggaaaataatttctcttgtattatctcctttgaagaaggcaaggctgataatatgacaaacatcattgtttagatgaggctcagagaggtagcactctcagagtgttttgaccagtttaagccgcagacctggagcttcagccaggtctgactccaaagctgttccattacaccacagcattgtgtggaatttgaggtctagagagaaccaataaaagtggtaattgggaactgaaatccttgagagttccggggagaaacccagagatgcctgatttcattcctcgatggtaatacccgtcctctcggctgccaggggctctgtggcaaaaagagtcagacatttctttggaaaacagcgaacagccttagagctcttgtgttcagaagaatcttcctggcacaatgttggagcagcaggcctctgggacccacagaacttgtggcctttatgttctttcacccatcctaggaaccagccaaccatcatgtgtagagcccctactgtgggcaaagtcctcctttcattaccctacagacagcttacaggagccagcctgcttcccacaactactagtgtgactccttatctctttccaccataccttagagactttgatactaccagggtctctcagggatggagggaagacctgaaagagaggactggttctgaggccagaaaggtgtgaggagagaggaggaaaagtcttcctaattgtgcccctaaagagcatcctgataccattctattctccagacatggaggggatgataaaggaaataggatctccactggacccttgattcattctgaaccctccaaaggaactctagagggcgagggatgatgagggaagcaataggtagctggggagccctattgctgctaagtcattggcaaagtgacaaagcaatttactgatgagagaatgtggaaatagatgtgcagtttggaattatgttggtgtgaatttgccagaggaccaatgcttgcatggagaatgggacgaggacatttgtgggcaagcagatgacagaggtttgaaggagaatggcatggcaggagtctctgccagttacttgggcttcaacagccaagctggcacaaaagacagctggcggaggctgctcggctactggttacctggagaagtagtatttgcctatttcccccttcatccatcctgagccaaatttcttttgctgaacaggaaagagctaggaaccctggaggtaaacaaagactttgatccatgtatgagtgtatgtgtttatgtaacttcctgtggatgcaaatagattcagagaaatttagagctaaaaaggcccttagagggaatctagcccaacctacattccaccctgttacttatgtagaaactgaggcccagagagggaagatgacctgccccaagtggtgagcaagcaccaacctccagactcagcagagtgagggggtaaagcagttcctgtcccacatggccatcttctttcttccacccacaaactccaggctggaagtacttggcccccttcaggagcctggccaggcagggagagagtagctgcagccttcatcagaactcttcctcctcccaaggcattctcccagctctagcctctggactggaaagcacaagactggcccagtgccagcaagtccttaggctactgtaatgctgcctcaggacccatccctgcctggaggctcctctaggccctgtgagcacaaagaagaaagctgatttttgtcttttaatccatttcaggactctctccaggagggctcggggtgtgtcatttctatattcctccagctgggattggggggtgggctttgttgtgagaatggcctggagcaggcccaatgctgcttttgggggtcagcatccagtgtgagatactgtgtatataaactatatataatgtatataaactgggatgtaagtttgtgtaaattaatggtttattctttgcaaataaaacgctttccccgtctgttcttg

SEQ ID NO: 129033 - DNA, 557 bp, Homo sapiens
  Payload ID: 5236
  Gene Symbol: EDA
  Gene Name: ectodysplasin A
  ENST ID: ENST00000503592
  CDS Start-End: 148-557
aactagatagaccattagtgtatccagagttgacattacctgtgttaaggctcttcgatcaagaacataactaggaatcattcgaggtgattcaaggcctgttttcctcaggtcttgctaagcctgtgacctgtcagctatgcttagatggccctattgaatttcttcttccctgatgaaaagccatactctgaagaagaaagtaggcgtgttcgccgcaataaaagaagcaaaagcaatgaaggagcagatggcccagttaaaaacaagaaaaagggaaagaaagcaggacctcctggacccaatggccctccaggacccccaggacctccaggaccccagggacccccaggaattccagggattcctggaattccaggaacaactgttatgggaccacctggtcctccaggtcctcctggtcctcaaggaccccctggcctccagggaccttctggtgctgctgataaagctggaactcgagaaaaccagccagctgtggtgcatctacagggccaagggtcagcaattcaagtcaagaatgatctttcaggtgg

SEQ ID NO: 129034 - DNA, 1381 bp, Homo sapiens
  Payload ID: 5236
  Gene Symbol: EDA
  Gene Name: ectodysplasin A
  Uniprot ID: Q92838
  ENST ID: ENST00000524573
  CDS Start-End: 193-1353
ttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccagatggccctattgaatttcttcttccctgatgaaaagccatactctgaagaagaaagtaggcgtgttcgccgcaataaaagaagcaaaagcaatgaaggagcagatggcccagttaaaaacaagaaaaagggaaagaaagcaggacctcctggacccaatggccctccaggacccccaggacctccaggaccccagggacccccaggaattccagggattcctggaattccaggaacaactgttatgggaccacctggtcctccaggtcctcctggtcctcaaggaccccctggcctccagggaccttctggtgctgctgataaagctggaactcgagaaaaccagccagctgtggtgcatctacagggccaagggtcagcaattcaagtcaagaatggtggagtgctcaatgactggtctcgcatcactatgaaccccaaggtgtttaagctacatccccgcagcggggagctggaggtactggtggacggcacctacttcatctatagtcaggtatactacatcaacttcactgactttgccagctatgaggtggtggtggatgagaagcccttcctgcagtgcacacgcagcatcgagacgggcaagaccaactacaacacttgctataccgcaggcgtctgcctcctcaaggcccggcagaagatcgccgtcaagatggtgcacgctgacatctccatcaacatgagcaagcacaccacgttctttggggccatcaggctgggtgaagcccctgcatcctagattccccccattttgcctctgtccgtgc

SEQ ID NO: 129035 - DNA, 843 bp, Homo sapiens
  Payload ID: 5236
  Gene Symbol: EDA
  Gene Name: ectodysplasin A
  Uniprot ID: Q92838
  ENST ID: ENST00000525810
  CDS Start-End: 243-650
attccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccagggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatgaacatttatatccactgaaaccactaagtgaaataaagatgtgtttaggcaaa

SEQ ID NO: 129036 - DNA, 927 bp, Homo sapiens
  Payload ID: 5236
  Gene Symbol: EDA
  Gene Name: ectodysplasin A
  Uniprot ID: Q92838
  ENST ID: ENST00000527388
  CDS Start-End: 243-689
attccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggactttgactacatcatttcattctcttatggcctacaaggtttctgctgagaaatccactgatattctaatggatattcctttggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatgaacatttatatccactgaaaccactaagtgaaataaagatgtgtttaggcaaa

SEQ ID NO: 129037 - DNA, 4643 bp, Homo sapiens
  Payload ID: 5236
  Gene Symbol: EDA
  Gene Name: ectodysplasin A
  ENST ID: ENST00000616899
  CDS Start-End: 4-783
cagatggccctattgaatttcttcttccctgatgaaaagccatactctgaagaagaaagtaggcgtgttcgccgcaataaaagaagcaaaagcaatgaaggagcagatggcccagttaaaaacaagaaaaagggaaagaaagcaggacctcctggacccaatggccctccaggacccccaggacctccaggaccccagggacccccaggaattccagggattcctggaattccaggaacaactgttatgggaccacctggtcctccaggtcctcctggtcctcaaggaccccctggcctccagggaccttctggtgctgctgataaagctggaactcgagaaaaccagccagctgtggtgcatctacagggccaagggtcagcaattcaagtcaagaatgatctttcaggtggagtgctcaatgactggtctcgcatcactatgaaccccaaggtgtttaagctacatccccgcagcggggagctggaggtactggtggacggcacctacttcatctatagtcaggtagaagtatactacatcaacttcactgactttgccagctatgaggtggtggtggatgagaagcccttcctgcagtgcacacgcagcatcgagacgggcaagaccaactacaacacttgctataccgcaggcgtctgcctcctcaaggcccggcagaagatcgccgtcaagatggtgcacgctgacatctccatcaacatgagcaagcacaccacgttctttggggccatcaggctgggtgaagcccctgcatcctagattccccccattttgcctctgtccgtgccccttccctgggtttgggagccaggactcccagaacctctaagtgctgctgtggagtgaggtgtattggtgttgcagccgcagagaaatgccccagtgttatttattccccagtgactccagggtgacaaggcctgcttgactttccagaatgaccttgagttaacaggacagttgatggagccccagggtttacatgaagcagaaccttctttggttccatgttgactgacttatggcatgactcttcaaccccgaggtccctgttgtcagatctattgtttgttgcactaaaatgaggatccagggcagcaggccagagaaagcaaaggtgcactccagactctgggggtggacatctgaccccaagggggctgctgctcctctcttgggtagggtagtggctggggtggagtgggaagggagcattgcagcctaagaagaaggccagagagggaaaaggcaggtgcttttggcagagaccataagagaaacctgccaaggagcatccttggcagtgggaatgttctttctgctctatactgtggcctgcaggagggttggagtgctcttcccactccagctgacagccacaccgtggcagcttgctgggctttgggaagtttgctgtgctttggaacaatcacagggaatggccacaaacctgcccgcctaagaccctgaatccgtacttgggtcacatgactctcattttatttacagctgtgctccacactcagaaaattccctggggtcaccttctagttgcccccattcccagcctgactagaactcctgtcttctttctccatggagcctacctctgtctgagacaggtgcctaacctgggacctgtggtcatgtgagtctgggatattctttagcttacctgggcacaaacagaattttccatttattaagcagtacaaatgtttttcatccattcctaatcaaattctgtctggggacgaagggttggacgggatgacctccagaagtcccttcaatttctagtacctgtgactcttagccctcaccacagccttctaaattcccaaatcctagactgctcctgggcattagcaaggcagagcctttttacctggcctagaaagggcaaggggtgaggataggacagagggattttgttcaagtttgctgcaacccaagtggacgttaggccaggccttatctgaaaggccagcagctgatgctgtactaacccagtctttcttcactctggcttcaaaaagccacagcagagcattgtcaccgcaggtgctcatgctgctcccctaaagccaggctcaggagaagccagtgtctaggcactgagcagggatctgccccctagttcaggtccaaattcaccttcccctaaaccccaagcttcccaacagatcatatggtaggaccctcgagagccttacttcaaagtgcctgggctcagcctggtttctgggtgctagatccagcccaaacctgggaaggccagccttgtacagtctgctcctcttgttcctgaaatgtgtttccttttcaggagatggggaataatttccttcaggcagctgaaattcaccaagaacagcgggtacttatttctcagctgtgccttccctttctaagcaaccacactgcttggcccttcaagggtcagggtgagacgtgatgggctaggcctccgttgtctggttgctaatgacagccttgcaacccaaggtgaggtgaactccaggcatgtgtctggccctaactcctataaagtgcctcggacagtccgcagttgtagcagaaaccaacaagaaccactccttcatgtttggaaaataatttctcttgtattatctcctttgaagaaggcaaggctgataatatgacaaacatcattgtttagatgaggctcagagaggtagcactctcagagtgttttgaccagtttaagccgcagacctggagcttcagccaggtctgactccaaagctgttccattacaccacagcattgtgtggaatttgaggtctagagagaaccaataaaagtggtaattgggaactgaaatccttgagagttccggggagaaacccagagatgcctgatttcattcctcgatggtaatacccgtcctctcggctgccaggggctctgtggcaaaaagagtcagacatttctttggaaaacagcgaacagccttagagctcttgtgttcagaagaatcttcctggcacaatgttggagcagcaggcctctgggacccacagaacttgtggcctttatgttctttcacccatcctaggaaccagccaaccatcatgtgtagagcccctactgtgggcaaagtcctcctttcattaccctacagacagcttacaggagccagcctgcttcccacaactactagtgtgactccttatctctttccaccataccttagagactttgatactaccagggtctctcagggatggagggaagacctgaaagagaggactggttctgaggccagaaaggtgtgaggagagaggaggaaaagtcttcctaattgtgcccctaaagagcatcctgataccattctattctccagacatggaggggatgataaaggaaataggatctccactggacccttgattcattctgaaccctccaaaggaactctagagggcgagggatgatgagggaagcaataggtagctggggagccctattgctgctaagtcattggcaaagtgacaaagcaatttactgatgagagaatgtggaaatagatgtgcagtttggaattatgttggtgtgaatttgccagaggaccaatgcttgcatggagaatgggacgaggacatttgtgggcaagcagatgacagaggtttgaaggagaatggcatggcaggagtctctgccagttacttgggcttcaacagccaagctggcacaaaagacagctggcggaggctgctcggctactggttacctggagaagtagtatttgcctatttcccccttcatccatcctgagccaaatttcttttgctgaacaggaaagagctaggaaccctggaggtaaacaaagactttgatccatgtatgagtgtatgtgtttatgtaacttcctgtggatgcaaatagattcagagaaatttagagctaaaaaggcccttagagggaatctagcccaacctacattccaccctgttacttatgtagaaactgaggcccagagagggaagatgacctgccccaagtggtgagcaagcaccaacctccagactcagcagagtgagggggtaaagcagttcctgtcccacatggccatcttctttcttccacccacaaactccaggctggaagtacttggcccccttcaggagcctggccaggcagggagagagtagctgcagccttcatcagaactcttcctcctcccaaggcattctcccagctctagcctctggactggaaagcacaagactggcccagtgccagcaagtccttaggctactgtaatgctgcctcaggacccatccctgcctggaggctcctctaggccctgtgagcacaaagaagaaagctgatttttgtcttttaatccatttcaggactctctccaggagggctcggggtgtgtcatttctatattcctccagctgggattggggggtgggctttgttgtgagaatggcctggagcaggcccaatgctgcttttgggggtcagcatccagtgtgagatactgtgtatataaactatatataatgtatataaactgggatgtaagtttgtgtaaattaatggtttattctttgcaaataaaacgctttccccgtctgttcttg

SEQ ID NO: 129038 - DNA, 4214 bp, Homo sapiens
  Payload ID: 5237
  Gene Symbol: EDAR
  Gene Name: ectodysplasin A receptor
  Uniprot ID: Q9UNE0
  ENST ID: ENST00000258443
  CDS Start-End: 432-1778
ggggcagacggccggagagccaggtgtgccagggacctatggcagcagggctgaacgtgcccgctccagcctctccagtgctgggagagacctctagatggtgcaggtgagtttgcaatgagggaaagcccctcggcaaggactgagtttccaaacttgcagacagggcagggagcggtcaaggaagagttcccgggaagccctttaaacggaaaggaagcggggctagtgtcagagaggtgtgccaggtcccaggcagccctgctggcccctaaggacatagagtacctgcttctgagagggctgccacggtggccacctgtgaagcctgtcacccagaactggatggtacctgactttcttcatagacccatcttctgctgggactgaagctgacctccaacagaagccaggtgagcccttgggagaggatggcccatgtgggggactgcacgcagacgccctggctccccgtcctggtggtgtctctgatgtgctcagcccgagcggaatactcaaactgcggtgagaacgagtactacaaccagactacggggctgtgccaggagtgccccccgtgtgggccgggagaggagccctacctgtcctgtggctacggcaccaaagacgaggactacggctgcgtcccctgcccggcggagaagttttccaaaggaggctaccagatatgcaggcgtcacaaagactgtgagggcttcttccgggccaccgtgctgacaccaggggacatggagaatgacgctgagtgtggcccttgcctccctggctactacatgctggagaacagaccgaggaacatctatggcatggtctgctactcctgcctcctggcaccccccaacaccaaggaatgtgtgggagccacttcaggagcttctgccaacttccctggcacctcgggcagcagcaccctgtctcccttccagcacgcccacaaagaactctcaggccaaggacacctggccactgccctgatcattgcaatgtccaccatcttcatcatggccatcgccatcgtcctcatcatcatgttctacatcctgaagacaaagccctctgccccagcctgttgcaccagccacccggggaagagcgtggaggcccaagtgagcaaggacgaggagaagaaagaggccccagacaacgtggtgatgttctccgagaaggatgaatttgagaagctgacagcaactccagcaaagcccaccaagagcgagaacgatgcctcatccgagaatgagcagctgctgagccggagcgtcgacagtgatgaggagcccgcccctgacaagcagggctccccggagctgtgcctgctgtcgctggttcacctggccagggagaagtctgccaccagcaacaagtcagccgggattcaaagccggaggaaaaagatcctcgatgtgtatgccaacgtgtgtggagtcgtggaaggtcttagccccacggagctgccatttgattgcctcgagaagactagccgaatgctcagctccacgtacaactctgagaaggctgttgtgaaaacgtggcgccacctcgccgagagcttcggcctgaagagggatgagattgggggcatgacagacggcatgcaactctttgaccgcatcagcacggcaggctacagcatccctgagctactcacaaaactggtgcagattgagcggctggatgctgtggagtccttgtgtgcagacatactggagtgggcgggggttgtgccacctgcctcccagccacatgctgcatcctgaaaagcatgcctgtgggctgtcctcccaggacaagccaaggagccaacgagggctctggagctgtgagtggtgccaaaagactgccaagaatcaaggcttttgtgatatgtcaccgtatgccttaggatgttcaaggagccagacgaaataaggcctgtcttccaatttaaccaaagataaaggactagagccgggatactttcagatgctcgcctgtacctcaccaggcagagtaaatatctactcactcatacagccagcccaccagcccaccattaactcactgaacaatgagacaatgttgaggactcaaatgaatcaaaccccgtgggaatgacagaagtgaagaatctggtccctgtctttaaggagtttgcactccagtagaagacagaaggaacgtatgtttacaaaccacttcactggaagacgtcaaacaagctgaatgaaggggcgcttagaaaacgttaatagaagttctaagcgggagatgactccctactgggatgatgaaggatggcatcctagtgaagaagcagctcaaacattttgataaaatggcaacaaaatgcagacaccctgctccaggtattatttcaggtttagtacaagtctgttaataccctatgtggtttcattaggataactttttacctatccttgaggtcatccatattcttacaggccttccagtcaataatggaagagctcactctatacaaaaccaatatgcaaggcatgtgtttgtccaagcaattggatgtgtgcagtagccaatttcatttactgcattactctttggcctgggaaccctgtggtctgcactacatgtgaatggccttccacttcagtcttaggcagatttgaccttttaggggcagcaatgctgaaggacacagcaatttaaattataatgtgtcaggctgtgttttcacttcaaacatgtatgagtagtcagctgtaattagagaaatgatgacttcctaagagttcagccacgcataattctagatttcaagagcatctaagacttgtggattagcctcatggcatgagagtttcagactcagccttctgagccagtcagggaaagtggagttctgcagcgcaaatgagagcctgggcttgatgtcgagggagctggcttctagttgtgccaccttgggccttgtcttttcctctctctgcctcagtttctcgtctgccaatgagatgttagttagtgattctataattggggcaggtagggttcaggtgagcaaaaagaaagtggagctataggaaatgccaggcctttgaggtgctctatggaagtcaacacagtgtggtttgtccatttaaatgggaataaaaacagaaaaactcagacttggcattttcacaataactgcaatggtttgacataacatttataggcagaaagttaataaactggcattgttcttggcatattattgtactatccctgtaactgccaagagctcaggagccaggctagtgatcacaccaggggttagagttcactgctgaactccctgatggcaggtctgtgtttattactacattaaaacaaagtctctgacttataaagcgaggttgtaaaaattacaagttgcatgactgaaaaaatgctttagggggaaaatcagtcatatctttaacaccaacaagcaatttcccaccaacgaatgtagtacatactgtgagaggatcataatgaggtcctgaatatttaatatcatcatttactgtgtctgtttgctgctgtttttcgaacctatttggtttaccctgcaagctaaatactccacggcagagcttaattatccttttaattcctctttgaaatcctgtggtgcccccttccccctgccttgtgatgatgatgagtgagtctccccttaattagactgcaaatgtcacttgtgatgagtgtgccattccaggataacagcttgcaccctcctcagaatgttttcagcgaaagagtggggtggctgttctctgctcctggtgctttggcctcatttcacactattagaattctggggctgtaaggccagccagtgtcagctcatgttccattggctctccacctgccatttttagggagctattccttatatagttacaaattcccttgtcatttacttatttggaaacatgggatttactctgacaagctttagcctatgttatgggattcagaacaatgagatcataataattctcactgaccaaagctgggactccatcctgccatttttgtgtggagatattcataattctgcaatactttaaaacatttagaaaacaccccagggtaggtctgtggcccttagacagtgaagtcttaattgtcaatattatttttgtctaattctgtatatatataacttattatattttataatctcaataaacacattaataaga

SEQ ID NO: 129039 - DNA, 4303 bp, Homo sapiens
  Payload ID: 5237
  Gene Symbol: EDAR
  Gene Name: ectodysplasin A receptor
  Uniprot ID: Q9UNE0
  ENST ID: ENST00000376651
  CDS Start-End: 432-1874
ggggcagacggccggagagccaggtgtgccagggacctatggcagcagggctgaacgtgcccgctccagcctctccagtgctgggagagacctctagatggtgcaggtgagtttgcaatgagggaaagcccctcggcaaggactgagtttccaaacttgcagacagggcagggagcggtcaaggaagagttcccgggaagccctttaaacggaaaggaagcggggctagtgtcagagaggtgtgccaggtcccaggcagccctgctggcccctaaggacatagagtacctgcttctgagagggctgccacggtggccacctgtgaagcctgtcacccagaactggatggtacctgactttcttcatagacccatcttctgctgggactgaagctgacctccaacagaagccaggtgagcccttgggagaggatggcccatgtgggggactgcacgcagacgccctggctccccgtcctggtggtgtctctgatgtgctcagcccgagcggaatactcaaactgcggtgagaacgagtactacaaccagactacggggctgtgccaggagtgccccccgtgtgggccgggagaggagccctacctgtcctgtggctacggcaccaaagacgaggactacggctgcgtcccctgcccggcggagaagttttccaaaggaggctaccagatatgcaggcgtcacaaagactgtgagggcttcttccgggccaccgtgctgacaccaggggacatggagaatgacgctgagtgtggcccttgcctccctggctactacatgctggagaacagaccgaggaacatctatggcatggtctgctactcctgcctcctggcaccccccaacaccaaggaatgtgtgggagccacttcaggagcttctgccaacttccctggcacctcgggcagcagcaccctgtctcccttccagcacgcccacaaagaactctcaggccaaggacacctggccactgccctgatcattgcaatgtccaccatcttcatcatggccatcgccatcgtcctcatcatcatgttctacatcctgaagacaaagccctctgccccaggtgacggcccccatgcgccggtgccctgcttcctggactctccgtcaactccccctgtcggagagcctggctgctcactccctcctctctccccagcctgttgcaccagccacccggggaagagcgtggaggcccaagtgagcaaggacgaggagaagaaagaggccccagacaacgtggtgatgttctccgagaaggatgaatttgagaagctgacagcaactccagcaaagcccaccaagagcgagaacgatgcctcatccgagaatgagcagctgctgagccggagcgtcgacagtgatgaggagcccgcccctgacaagcagggctccccggagctgtgcctgctgtcgctggttcacctggccagggagaagtctgccaccagcaacaagtcagccgggattcaaagccggaggaaaaagatcctcgatgtgtatgccaacgtgtgtggagtcgtggaaggtcttagccccacggagctgccatttgattgcctcgagaagactagccgaatgctcagctccacgtacaactctgagaaggctgttgtgaaaacgtggcgccacctcgccgagagcttcggcctgaagagggatgagattgggggcatgacagacggcatgcaactctttgaccgcatcagcacggcaggctacagcatccctgagctactcacaaaactggtgcagattgagcggctggatgctgtggagtccttgtgtgcagacatactggagtgggcgggggttgtgccacctgcctcccagccacatgctgcatcctgaaaagcatgcctgtgggctgtcctcccaggacaagccaaggagccaacgagggctctggagctgtgagtggtgccaaaagactgccaagaatcaaggcttttgtgatatgtcaccgtatgccttaggatgttcaaggagccagacgaaataaggcctgtcttccaatttaaccaaagataaaggactagagccgggatactttcagatgctcgcctgtacctcaccaggcagagtaaatatctactcactcatacagccagcccaccagcccaccattaactcactgaacaatgagacaatgttgaggactcaaatgaatcaaaccccgtgggaatgacagaagtgaagaatctggtccctgtctttaaggagtttgcactccagtagaagacagaaggaacgtatgtttacaaaccacttcactggaagacgtcaaacaagctgaatgaaggggcgcttagaaaacgttaatagaagttctaagcgggagatgactccctactgggatgatgaaggatggcatcctagtgaagaagcagctcaaacattttgataaaatggcaacaaaatgcagacaccctgctccaggtattatttcaggtttagtacaagtctgttaataccctatgtggtttcattaggataactttttacctatccttgaggtcatccatattcttacaggccttccagtcaataatggaagagctcactctatacaaaaccaatatgcaaggcatgtgtttgtccaagcaattggatgtgtgcagtagccaatttcatttactgcattactctttggcctgggaaccctgtggtctgcactacatgtgaatggccttccacttcagtcttaggcagatttgaccttttaggggcagcaatgctgaaggacacagcaatttaaattataatgtgtcaggctgtgttttcacttcaaacatgtatgagtagtcagctgtaattagagaaatgatgacttcctaagagttcagccacgcataattctagatttcaagagcatctaagacttgtggattagcctcatggcatgagagtttcagactcagccttctgagccagtcagggaaagtggagttctgcagcgcaaatgagagcctgggcttgatgtcgagggagctggcttctagttgtgccaccttgggccttgtcttttcctctctctgcctcagtttctcgtctgccaatgagatgttagttagtgattctataattggggcaggtagggttcaggtgagcaaaaagaaagtggagctataggaaatgccaggcctttgaggtgctctatggaagtcaacacagtgtggtttgtccatttaaatgggaataaaaacagaaaaactcagacttggcattttcacaataactgcaatggtttgacataacatttataggcagaaagttaataaactggcattgttcttggcatattattgtactatccctgtaactgccaagagctcaggagccaggctagtgatcacaccaggggttagagttcactgctgaactccctgatggcaggtctgtgtttattactacattaaaacaaagtctctgacttataaagcgaggttgtaaaaattacaagttgcatgactgaaaaaatgctttagggggaaaatcagtcatatctttaacaccaacaagcaatttcccaccaacgaatgtagtacatactgtgagaggatcataatgaggtcctgaatatttaatatcatcatttactgtgtctgtttgctgctgtttttcgaacctatttggtttaccctgcaagctaaatactccacggcagagcttaattatccttttaattcctctttgaaatcctgtggtgcccccttccccctgccttgtgatgatgatgagtgagtctccccttaattagactgcaaatgtcacttgtgatgagtgtgccattccaggataacagcttgcaccctcctcagaatgttttcagcgaaagagtggggtggctgttctctgctcctggtgctttggcctcatttcacactattagaattctggggctgtaaggccagccagtgtcagctcatgttccattggctctccacctgccatttttagggagctattccttatatagttacaaattcccttgtcatttacttatttggaaacatgggatttactctgacaagctttagcctatgttatgggattcagaacaatgagatcataataattctcactgaccaaagctgggactccatcctgccatttttgtgtggagatattcataattctgcaatactttaaaacatttagaaaacaccccagggtaggtctgtggcccttagacagtgaagtcttaattgtcaatattatttttgtctaattctgtatatatataacttattatattttataatctcaataaacacatt

SEQ ID NO: 129040 - DNA, 4323 bp, Homo sapiens
  Payload ID: 5237
  Gene Symbol: EDAR
  Gene Name: ectodysplasin A receptor
  Uniprot ID: Q9UNE0
  ENST ID: ENST00000409271
  CDS Start-End: 445-1887
caggtgagtttgcaatgagggaaagcccctcggcaaggactgagtttccaaacttgcagacagggcagggagcggtcaaggaagagttcccgggaagccctttaaacggaaaggaagcggggctagtgtcagagaggtgtgccaggtcccaggcagccctgctggcccctaaggacatagagtacctgcttctgagagggctgccacggtggccacctgtgaagcctgtcacccagaactggatggtacctgactttcttcatagacccatcttctgctgggactgaagctgacctccaacagaagccagaccatccgagccatcctgggaggctcagcctccaccacccatgtgggcaccttctgcattacctacaatagccagcctgagaggagcagcaagccctctgcaggccctcgggacacgtgagcccttgggagaggatggcccatgtgggggactgcacgcagacgccctggctccccgtcctggtggtgtctctgatgtgctcagcccgagcggaatactcaaactgcggtgagaacgagtactacaaccagactacggggctgtgccaggagtgccccccgtgtgggccgggagaggagccctacctgtcctgtggctacggcaccaaagacgaggactacggctgcgtcccctgcccggcggagaagttttccaaaggaggctaccagatatgcaggcgtcacaaagactgtgagggcttcttccgggccaccgtgctgacaccaggggacatggagaatgacgctgagtgtggcccttgcctccctggctactacatgctggagaacagaccgaggaacatctatggcatggtctgctactcctgcctcctggcaccccccaacaccaaggaatgtgtgggagccacttcaggagcttctgccaacttccctggcacctcgggcagcagcaccctgtctcccttccagcacgcccacaaagaactctcaggccaaggacacctggccactgccctgatcattgcaatgtccaccatcttcatcatggccatcgccatcgtcctcatcatcatgttctacatcctgaagacaaagccctctgccccaggtgacggcccccatgcgccggtgccctgcttcctggactctccgtcaactccccctgtcggagagcctggctgctcactccctcctctctccccagcctgttgcaccagccacccggggaagagcgtggaggcccaagtgagcaaggacgaggagaagaaagaggccccagacaacgtggtgatgttctccgagaaggatgaatttgagaagctgacagcaactccagcaaagcccaccaagagcgagaacgatgcctcatccgagaatgagcagctgctgagccggagcgtcgacagtgatgaggagcccgcccctgacaagcagggctccccggagctgtgcctgctgtcgctggttcacctggccagggagaagtctgccaccagcaacaagtcagccgggattcaaagccggaggaaaaagatcctcgatgtgtatgccaacgtgtgtggagtcgtggaaggtcttagccccacggagctgccatttgattgcctcgagaagactagccgaatgctcagctccacgtacaactctgagaaggctgttgtgaaaacgtggcgccacctcgccgagagcttcggcctgaagagggatgagattgggggcatgacagacggcatgcaactctttgaccgcatcagcacggcaggctacagcatccctgagctactcacaaaactggtgcagattgagcggctggatgctgtggagtccttgtgtgcagacatactggagtgggcgggggttgtgccacctgcctcccagccacatgctgcatcctgaaaagcatgcctgtgggctgtcctcccaggacaagccaaggagccaacgagggctctggagctgtgagtggtgccaaaagactgccaagaatcaaggcttttgtgatatgtcaccgtatgccttaggatgttcaaggagccagacgaaataaggcctgtcttccaatttaaccaaagataaaggactagagccgggatactttcagatgctcgcctgtacctcaccaggcagagtaaatatctactcactcatacagccagcccaccagcccaccattaactcactgaacaatgagacaatgttgaggactcaaatgaatcaaaccccgtgggaatgacagaagtgaagaatctggtccctgtctttaaggagtttgcactccagtagaagacagaaggaacgtatgtttacaaaccacttcactggaagacgtcaaacaagctgaatgaaggggcgcttagaaaacgttaatagaagttctaagcgggagatgactccctactgggatgatgaaggatggcatcctagtgaagaagcagctcaaacattttgataaaatggcaacaaaatgcagacaccctgctccaggtattatttcaggtttagtacaagtctgttaataccctatgtggtttcattaggataactttttacctatccttgaggtcatccatattcttacaggccttccagtcaataatggaagagctcactctatacaaaaccaatatgcaaggcatgtgtttgtccaagcaattggatgtgtgcagtagccaatttcatttactgcattactctttggcctgggaaccctgtggtctgcactacatgtgaatggccttccacttcagtcttaggcagatttgaccttttaggggcagcaatgctgaaggacacagcaatttaaattataatgtgtcaggctgtgttttcacttcaaacatgtatgagtagtcagctgtaattagagaaatgatgacttcctaagagttcagccacgcataattctagatttcaagagcatctaagacttgtggattagcctcatggcatgagagtttcagactcagccttctgagccagtcagggaaagtggagttctgcagcgcaaatgagagcctgggcttgatgtcgagggagctggcttctagttgtgccaccttgggccttgtcttttcctctctctgcctcagtttctcgtctgccaatgagatgttagttagtgattctataattggggcaggtagggttcaggtgagcaaaaagaaagtggagctataggaaatgccaggcctttgaggtgctctatggaagtcaacacagtgtggtttgtccatttaaatgggaataaaaacagaaaaactcagacttggcattttcacaataactgcaatggtttgacataacatttataggcagaaagttaataaactggcattgttcttggcatattattgtactatccctgtaactgccaagagctcaggagccaggctagtgatcacaccaggggttagagttcactgctgaactccctgatggcaggtctgtgtttattactacattaaaacaaagtctctgacttataaagcgaggttgtaaaaattacaagttgcatgactgaaaaaatgctttagggggaaaatcagtcatatctttaacaccaacaagcaatttcccaccaacgaatgtagtacatactgtgagaggatcataatgaggtcctgaatatttaatatcatcatttactgtgtctgtttgctgctgtttttcgaacctatttggtttaccctgcaagctaaatactccacggcagagcttaattatccttttaattcctctttgaaatcctgtggtgcccccttccccctgccttgtgatgatgatgagtgagtctccccttaattagactgcaaatgtcacttgtgatgagtgtgccattccaggataacagcttgcaccctcctcagaatgttttcagcgaaagagtggggtggctgttctctgctcctggtgctttggcctcatttcacactattagaattctggggctgtaaggccagccagtgtcagctcatgttccattggctctccacctgccatttttagggagctattccttatatagttacaaattcccttgtcatttacttatttggaaacatgggatttactctgacaagctttagcctatgttatgggattcagaacaatgagatcataataattctcactgaccaaagctgggactccatcctgccatttttgtgtggagatattcataattctgcaatactttaaaacatttagaaaacaccccagggtaggtctgtggcccttagacagtgaagtcttaattgtcaatattatttttgtctaattctgtatatatataacttattatattttataatctcaataaacacattaataaga

SEQ ID NO: 129041 - DNA, 957 bp, Homo sapiens
  Payload ID: 5238
  Gene Symbol: EDA2R
  Gene Name: ectodysplasin A2 receptor
  Uniprot ID: Q9HAV5
  ENST ID: ENST00000253392
  CDS Start-End: 1-957
atggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatacacccacagtgccccctcaggaggccacacttgttgcactggtgagcagcctgctagtggtgtttaccctggccttcctggggctcttcttcctctactgcaagcagttcttcaacagacattgccagcgtgagaaattgattattttctctgatccagtaccagctagcctcaatctgatacctgaatttgcaggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaa

SEQ ID NO: 129042 - DNA, 3418 bp, Homo sapiens
  Payload ID: 5238
  Gene Symbol: EDA2R
  Gene Name: ectodysplasin A2 receptor
  Uniprot ID: Q9HAV5
  ENST ID: ENST00000374719
  CDS Start-End: 58-951
ccggagtcccatttgggagcaagagccatctactcgtccgttaccggccttcccaccatggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatacacccacagtgccccctcaggaggccacacttgttgcactggtgagcagcctgctagtggtgtttaccctggccttcctggggctcttcttcctctactgcaagcagttcttcaacagacattgccagcgtggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaactctaatgaggtctcttgggcccctggcagccttgcccagttgttctctctggactctgttcctataccacaacagcagcaggggcctgaaatgtgatgtccacaagagctaataccctacagatggggcatatcctatcccatcccaccagaggattgattctccatttcacaaggactgatctggagcatttcttgcttcccttttgtagtctggggagccagattccacattcatgggactaccagacatgttcctagctcaacttgattatagagaagaggagagaggacagtgaatggggtagggttttcatgtctgcatttttggtcaggtaagcctctcaaaattgtgttggcacatctacctagcactttagggacaaaatcaaacccttctccccttttagctcctccacactgtctccctcctcaacacacacacacacacatacacacacatatacatagacacacaaacacacacacacacattaatatctatcttgggggaggcctcgtgccataattcccaagttcatgtctcagactgctgcattgcagcatgaggcagggcaaacactttccctctagatccctggggcctcaccctgtatttgaggttctcaccaccctcagcagggagaagggctgaagttcgccattttggaaccttacagaacatttctgagccaaagtaatcttccttctggggcctgagttccccaaactaccccacagcagtccctcaaagacagccctcaatccatgtagggacatctgagtatgcctctttctattgaaatgtcaattcaatcccagctttctcaccaccgttcccctttgattctttctcaattgtctttttgcctttagctcccacctatacatctcatgctcagagaaaaacaagttccttagaggttgtattctttattctccaagaatctgtctgaaacttgtacagctagttcctgtcccacaactattaagtggtttattaagtacattaggcagaatgtgcacttcatcaccaggttctagctctggcaaaggagtgctgtctacagcaagatttttgcttttagaattttattaactacatcttttgggttcatccatctacaaacactgattaagggcccctggggcaaccaattgatcagattactaaaaggacttgggaaaaagcaaaaaggtcccattgtactggactgaggattagaagcaattgaaatacaagcctgtaccaagcaagcagcctggccccacacaggtattagcaaatatgtggtaaccaaggttttaggccttggcctttaggtttcctgttttttttttgtttttgtttttgtttttgtttttctgcaacaggttattcttatctcactggctttcactgatcatgtttagaccttctggtagaagaaataatatccagacaggggatgatttggcttcagcaggctgcaggtgttcaaaggttgccatgtggctggcagtggttcaagcccacatttgacactgctgctctagaggaaagataatgatggtaacacagtaataataataataataacaaaaatatgataaagtgaaagagtaagacttcttcagtgtgcttgctcatggcatgaatgctatgtggacagcccaagccatacccagaatcaccttaattccaactttttgaggttcagcaattggaggtggcaattggctttgcattttaaagtatttcgggtaaaggtgaagtgaaggattttcgtctttataatttctgtttggccatggcaaataccatagttgagtatttgcttcaggagagttctttttacagttttacttttcaatgctgaggcatatttctttgagcactgtgcttttatgtgtctttctacaaaggggttattggtcagtggaagaacaaagtacacttgataaaaacattttcaacatacattgagcctaaacagcagttaagttgtctctaaatgaactagcaaaaaaaaaaaatgtagtttttgtttgtaaggaaggggaggtatttcctgagaatgaatttttttttttttggattactgtttttctctccatataccttgacttggattttgacaggagggagcctgggaaaataattttttcctccaagattctcagatccaggttaggaaaggattcagcactacagcatacccctctacaacatacagccctgtcacattgagatcataatccctcctgtcccactcctctctaccaaccccaccctactagctaggtcttcagtgttttacattgaatattggtacattttaattattttttctcataaatgggttatttatagaaattttgttaactcttgagccatatgcatgtgtagatactggcagggctatgtttgtttatgatgctctgcaaacatttcatattggccaataaacagaaatatatccaaaaa

SEQ ID NO: 129043 - DNA, 3429 bp, Homo sapiens
  Payload ID: 5238
  Gene Symbol: EDA2R
  Gene Name: ectodysplasin A2 receptor
  Uniprot ID: Q9HAV5
  ENST ID: ENST00000396050
  CDS Start-End: 11-967
ccttcccaccatggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatacacccacagtgccccctcaggaggccacacttgttgcactggtgagcagcctgctagtggtgtttaccctggccttcctggggctcttcttcctctactgcaagcagttcttcaacagacattgccagcgtgagaaattgattattttctctgatccagtaccagctagcctcaatctgatacctgaatttgcaggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaactctaatgaggtctcttgggcccctggcagccttgcccagttgttctctctggactctgttcctataccacaacagcagcaggggcctgaaatgtgatgtccacaagagctaataccctacagatggggcatatcctatcccatcccaccagaggattgattctccatttcacaaggactgatctggagcatttcttgcttcccttttgtagtctggggagccagattccacattcatgggactaccagacatgttcctagctcaacttgattatagagaagaggagagaggacagtgaatggggtagggttttcatgtctgcatttttggtcaggtaagcctctcaaaattgtgttggcacatctacctagcactttagggacaaaatcaaacccttctccccttttagctcctccacactgtctccctcctcaacacacacacacacacatacacacacatatacatagacacacaaacacacacacacacattaatatctatcttgggggaggcctcgtgccataattcccaagttcatgtctcagactgctgcattgcagcatgaggcagggcaaacactttccctctagatccctggggcctcaccctgtatttgaggttctcaccaccctcagcagggagaagggctgaagttcgccattttggaaccttacagaacatttctgagccaaagtaatcttccttctggggcctgagttccccaaactaccccacagcagtccctcaaagacagccctcaatccatgtagggacatctgagtatgcctctttctattgaaatgtcaattcaatcccagctttctcaccaccgttcccctttgattctttctcaattgtctttttgcctttagctcccacctatacatctcatgctcagagaaaaacaagttccttagaggttgtattctttattctccaagaatctgtctgaaacttgtacagctagttcctgtcccacaactattaagtggtttattaagtacattaggcagaatgtgcacttcatcaccaggttctagctctggcaaaggagtgctgtctacagcaagatttttgcttttagaattttattaactacatcttttgggttcatccatctacaaacactgattaagggcccctggggcaaccaattgatcagattactaaaaggacttgggaaaaagcaaaaaggtcccattgtactggactgaggattagaagcaattgaaatacaagcctgtaccaagcaagcagcctggccccacacaggtattagcaaatatgtggtaaccaaggttttaggccttggcctttaggtttcctgttttttttttgtttttgtttttgtttttgtttttctgcaacaggttattcttatctcactggctttcactgatcatgtttagaccttctggtagaagaaataatatccagacaggggatgatttggcttcagcaggctgcaggtgttcaaaggttgccatgtggctggcagtggttcaagcccacatttgacactgctgctctagaggaaagataatgatggtaacacagtaataataataataataacaaaaatatgataaagtgaaagagtaagacttcttcagtgtgcttgctcatggcatgaatgctatgtggacagcccaagccatacccagaatcaccttaattccaactttttgaggttcagcaattggaggtggcaattggctttgcattttaaagtatttcgggtaaaggtgaagtgaaggattttcgtctttataatttctgtttggccatggcaaataccatagttgagtatttgcttcaggagagttctttttacagttttacttttcaatgctgaggcatatttctttgagcactgtgcttttatgtgtctttctacaaaggggttattggtcagtggaagaacaaagtacacttgataaaaacattttcaacatacattgagcctaaacagcagttaagttgtctctaaatgaactagcaaaaaaaaaaaatgtagtttttgtttgtaaggaaggggaggtatttcctgagaatgaatttttttttttttggattactgtttttctctccatataccttgacttggattttgacaggagggagcctgggaaaataattttttcctccaagattctcagatccaggttaggaaaggattcagcactacagcatacccctctacaacatacagccctgtcacattgagatcataatccctcctgtcccactcctctctaccaaccccaccctactagctaggtcttcagtgttttacattgaatattggtacattttaattattttttctcataaatgggttatttatagaaattttgttaactcttgagccatatgcatgtgtagatactggcagggctatgtttgtttatgatgctctgcaaacatttcatattggccaataaacagaaatatatcc

SEQ ID NO: 129044 - DNA, 3464 bp, Homo sapiens
  Payload ID: 5238
  Gene Symbol: EDA2R
  Gene Name: ectodysplasin A2 receptor
  Uniprot ID: Q9HAV5
  ENST ID: ENST00000451436
  CDS Start-End: 109-1002
ggtaagcttaccgtgaaaggagggtttgggctgttgttgctacacgtggatgtgaaatgagtcaagcggaactttgattacaaggaatttcatatactccttcccaccatggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatacacccacagtgccccctcaggaggccacacttgttgcactggtgagcagcctgctagtggtgtttaccctggccttcctggggctcttcttcctctactgcaagcagttcttcaacagacattgccagcgtggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaactctaatgaggtctcttgggcccctggcagccttgcccagttgttctctctggactctgttcctataccacaacagcagcaggggcctgaaatgtgatgtccacaagagctaataccctacagatggggcatatcctatcccatcccaccagaggattgattctccatttcacaaggactgatctggagcatttcttgcttcccttttgtagtctggggagccagattccacattcatgggactaccagacatgttcctagctcaacttgattatagagaagaggagagaggacagtgaatggggtagggttttcatgtctgcatttttggtcaggtaagcctctcaaaattgtgttggcacatctacctagcactttagggacaaaatcaaacccttctccccttttagctcctccacactgtctccctcctcaacacacacacacacacatacacacacatatacatagacacacaaacacacacacacacattaatatctatcttgggggaggcctcgtgccataattcccaagttcatgtctcagactgctgcattgcagcatgaggcagggcaaacactttccctctagatccctggggcctcaccctgtatttgaggttctcaccaccctcagcagggagaagggctgaagttcgccattttggaaccttacagaacatttctgagccaaagtaatcttccttctggggcctgagttccccaaactaccccacagcagtccctcaaagacagccctcaatccatgtagggacatctgagtatgcctctttctattgaaatgtcaattcaatcccagctttctcaccaccgttcccctttgattctttctcaattgtctttttgcctttagctcccacctatacatctcatgctcagagaaaaacaagttccttagaggttgtattctttattctccaagaatctgtctgaaacttgtacagctagttcctgtcccacaactattaagtggtttattaagtacattaggcagaatgtgcacttcatcaccaggttctagctctggcaaaggagtgctgtctacagcaagatttttgcttttagaattttattaactacatcttttgggttcatccatctacaaacactgattaagggcccctggggcaaccaattgatcagattactaaaaggacttgggaaaaagcaaaaaggtcccattgtactggactgaggattagaagcaattgaaatacaagcctgtaccaagcaagcagcctggccccacacaggtattagcaaatatgtggtaaccaaggttttaggccttggcctttaggtttcctgttttttttttgtttttgtttttgtttttgtttttctgcaacaggttattcttatctcactggctttcactgatcatgtttagaccttctggtagaagaaataatatccagacaggggatgatttggcttcagcaggctgcaggtgttcaaaggttgccatgtggctggcagtggttcaagcccacatttgacactgctgctctagaggaaagataatgatggtaacacagtaataataataataataacaaaaatatgataaagtgaaagagtaagacttcttcagtgtgcttgctcatggcatgaatgctatgtggacagcccaagccatacccagaatcaccttaattccaactttttgaggttcagcaattggaggtggcaattggctttgcattttaaagtatttcgggtaaaggtgaagtgaaggattttcgtctttataatttctgtttggccatggcaaataccatagttgagtatttgcttcaggagagttctttttacagttttacttttcaatgctgaggcatatttctttgagcactgtgcttttatgtgtctttctacaaaggggttattggtcagtggaagaacaaagtacacttgataaaaacattttcaacatacattgagcctaaacagcagttaagttgtctctaaatgaactagcaaaaaaaaaaaatgtagtttttgtttgtaaggaaggggaggtatttcctgagaatgaatttttttttttttggattactgtttttctctccatataccttgacttggattttgacaggagggagcctgggaaaataattttttcctccaagattctcagatccaggttaggaaaggattcagcactacagcatacccctctacaacatacagccctgtcacattgagatcataatccctcctgtcccactcctctctaccaaccccaccctactagctaggtcttcagtgttttacattgaatattggtacattttaattattttttctcataaatgggttatttatagaaattttgttaactcttgagccatatgcatgtgtagatactggcagggctatgtttgtttatgatgctctgcaaacatttcatattggccaataaacagaaatatatcc

SEQ ID NO: 129045 - DNA, 2982 bp, Homo sapiens
  Payload ID: 5239
  Gene Symbol: ENOX1
  Gene Name: ecto-NOX disulfide-thiol exchanger 1
  Uniprot ID: Q8TC92
  ENST ID: ENST00000261488
  CDS Start-End: 579-2510
gcagatccccgctctcccgggcgccgctactcacacaggcttccagccgccacggggcgtcctctgtctgctgcagcggcggcggcagcagagggaacggcgactgcagcccggccgcgtctcccagctccgtgcccgggacagagtccgggagaagcaaaggaggaggaggacgccgaggctaggaggagccgcgccgcgcccggcgccccactccgcgcagcgggttgcctccgctccccatacggcggccccaggtcctttgctgccagcatgatgtcgtatttataatatgtggaggagagagagctcaccatgctcaggtaaagggatggtatgtgcaccacaaataacaagcagaagcctctgatatgtcagaaccatgctgtcttccatgagacttcctttgtgaagagcatccatttaaaagacttttatgaatacatggtttcaatcaagtccccagagaacacatttgtcttctgagctgctggcagttttgagaatctgatgacctccgaggggaccctgcactcagccatcaaagtgttcctgcccctctggacactcataattcaatggtagatgcaggtggagttgagaacatcacccagcttccccaggagcttcctcagatgatggctgcagcagccgatggtttggggagtatagcgatagacacgacccagctcaacatgtccgtgacagatcccacagcctgggctacagccatgaataacctgggcatggttcccgtagggttgcctggacagcagctcgtgtctgactcaatctgtgtcccaggctttgatccaagcctcaacatgatgactggaatcacccccattaacccaatgataccaggccttggactggtacctcccccaccaccaacagaagtggctgttgtcaaagaaataatccactgcaaaagctgtactctttttcctcaaaatccaaatcttccacctccttccacaagagaacgacctcctgggtgtaagaccgtgtttgtcggaggattaccagaaaatgctactgaggaaattattcaagaagtctttgaacagtgcggtgatattacagcaattcggaaaagcaagaagaatttttgtcacattcgctttgcagaggaattcatggttgataaagccatttacctttctggttataggatgcgattagggtctagcaccgacaaaaaggattcaggccgccttcatgtggactttgcccaggccagggatgacttctatgagtgggaatgcaagcagaggatgcgtgcccgggaggagcggcaccggcgcaagctggaggaggaccggctcaggcccccatccccgcctgccataatgcactactcggagcacgaagccgctctgctggctgaaaagctgaaagatgatagcaagttttcagaggctatcacagtgctgctttcctggattgaacgaggggaagtgaatcggcgctctgcaaaccagttctattccatggtgcagtcggccaacagccacgtccgccggctaatgaatgaaaaagccacccatgagcaagagatggaggaagccaaggagaattttaaaaatgccttaactgggattctcactcaatttgagcagattgtggccgttttcaacgcttctaccagacaaaaagcttgggaccatttctcgaaagcccagcgcaagaacatagacatttggcgaaagcattctgaggagctccggaatgctcaaagtgagcagctcatgggcatccgccgcgaagaagaaatggaaatgtctgatgatgagaactgtgacagccctacaaagaaaatgagagtcgatgaatcagccctggctgcccaggcctacgctctgaaagaggagaatgacagtctccgctggcagctggatgcctacaggaatgaggtggagctgctgaaacaagaaaaagaacagcttttccgaacagaagaaaacctcaccaaggaccagcaactgcagtttctgcagcaaaccatgcaaggcatgcagcagcaattgctaaccatccaggaggagttaaacaacaaaaagtcagaattggaacaagcaaaggaagagcagtcccatacacaagcgttactaaaagtcctgcaggaacaattaaaaggtaccaaggaattggtcgagaccaatggccacagccatgaggattcaaatgaaatcaatgtgttgacagttgcattagtcaaccaagaccgagagaacaatattgagaaaagaagccaaggcttaaaatcagagaaagaagctctgctaataggtatcatatcaacgtttcttcacgtccatccttttggagccaacatagaatatctttggtcatacatgcagcagctggactccaagatatctgcaaatgaaatagaaatgcttttgatgaggctgccacgcatgttcaaacaggaattcacgggtgtgggagccacgctggaaaaaagatggaagctgtgtgcctttgaaggaattaaaactacctaactgcgaagagcaaagcatctctggaaatgaaaccatgtgaacctggccagggcggtgcgacggggaagcaggaggtgtggggttggtccagcacgcaacctttgtggagccatcgaagcctgcctttagttatatctgtggcgttctcttgtaagtggaaatgtaattgtgtaccagtttcttaaaataaacaaagcttcatactgtgacagatctgtttcctatgaaaaccaaacaatgattccacagtcataatgatggcaaaatcttaaaatgtgctacatttgagaatagctcaccaagcaaaatatttaaagttaatgatggtgtagcaatgattgttgctaggctacagagttgtatatgtaatgtatagctgaaatcattaaatgacattttcctgaaagtctttctgttttagtaaaaaaaaaaaaaaaaaaaaaaagaaaaagaaaaagaaaaaaagaaaaaa

SEQ ID NO: 129046 - DNA, 2610 bp, Homo sapiens
  Payload ID: 5239
  Gene Symbol: ENOX1
  Gene Name: ecto-NOX disulfide-thiol exchanger 1
  Uniprot ID: Q8TC92
  ENST ID: ENST00000412891
  CDS Start-End: 257-2188
gatggacagaagatggaaaaatttcttacatgaatgaaaagcctctgatatgtcagaaccatgctgtcttccatgagacttcctttgtgaagagcatccatttaaaagacttttatgaatacatggtttcaatcaagtccccagagaacacatttgtcttctgagctgctggcagttttgagaatctgatgacctccgaggggaccctgcactcagccatcaaagtgttcctgcccctctggacactcataattcaatggtagatgcaggtggagttgagaacatcacccagcttccccaggagcttcctcagatgatggctgcagcagccgatggtttggggagtatagcgatagacacgacccagctcaacatgtccgtgacagatcccacagcctgggctacagccatgaataacctgggcatggttcccgtagggttgcctggacagcagctcgtgtctgactcaatctgtgtcccaggctttgatccaagcctcaacatgatgactggaatcacccccattaacccaatgataccaggccttggactggtacctcccccaccaccaacagaagtggctgttgtcaaagaaataatccactgcaaaagctgtactctttttcctcaaaatccaaatcttccacctccttccacaagagaacgacctcctgggtgtaagaccgtgtttgtcggaggattaccagaaaatgctactgaggaaattattcaagaagtctttgaacagtgcggtgatattacagcaattcggaaaagcaagaagaatttttgtcacattcgctttgcagaggaattcatggttgataaagccatttacctttctggttataggatgcgattagggtctagcaccgacaaaaaggattcaggccgccttcatgtggactttgcccaggccagggatgacttctatgagtgggaatgcaagcagaggatgcgtgcccgggaggagcggcaccggcgcaagctggaggaggaccggctcaggcccccatccccgcctgccataatgcactactcggagcacgaagccgctctgctggctgaaaagctgaaagatgatagcaagttttcagaggctatcacagtgctgctttcctggattgaacgaggggaagtgaatcggcgctctgcaaaccagttctattccatggtgcagtcggccaacagccacgtccgccggctaatgaatgaaaaagccacccatgagcaagagatggaggaagccaaggagaattttaaaaatgccttaactgggattctcactcaatttgagcagattgtggccgttttcaacgcttctaccagacaaaaagcttgggaccatttctcgaaagcccagcgcaagaacatagacatttggcgaaagcattctgaggagctccggaatgctcaaagtgagcagctcatgggcatccgccgcgaagaagaaatggaaatgtctgatgatgagaactgtgacagccctacaaagaaaatgagagtcgatgaatcagccctggctgcccaggcctacgctctgaaagaggagaatgacagtctccgctggcagctggatgcctacaggaatgaggtggagctgctgaaacaagaaaaagaacagcttttccgaacagaagaaaacctcaccaaggaccagcaactgcagtttctgcagcaaaccatgcaaggcatgcagcagcaattgctaaccatccaggaggagttaaacaacaaaaagtcagaattggaacaagcaaaggaagagcagtcccatacacaagcgttactaaaagtcctgcaggaacaattaaaaggtaccaaggaattggtcgagaccaatggccacagccatgaggattcaaatgaaatcaatgtgttgacagttgcattagtcaaccaagaccgagagaacaatattgagaaaagaagccaaggcttaaaatcagagaaagaagctctgctaataggtatcatatcaacgtttcttcacgtccatccttttggagccaacatagaatatctttggtcatacatgcagcagctggactccaagatatctgcaaatgaaatagaaatgcttttgatgaggctgccacgcatgttcaaacaggaattcacgggtgtgggagccacgctggaaaaaagatggaagctgtgtgcctttgaaggaattaaaactacctaactgcgaagagcaaagcatctctggaaatgaaaccatgtgaacctggccagggcggtgcgacggggaagcaggaggtgtggggttggtccagcacgcaacctttgtggagccatcgaagcctgcctttagttatatctgtggcgttctcttgtaagtggaaatgtaattgtgtaccagtttcttaaaataaacaaagcttcatactgtgacagatctgtttcctatgaaaaccaaacaatgattccacagtcataatgatggcaaaatcttaaaatgtgctacatttgagaatagctcaccaagcaaaatatttaaagttaatgatggtgtagcaatgattgttgctaggctacagagttgtatatgtaatgtatagctgaaatcattaaatgacattttcctgaaagtctttctgttttagt

SEQ ID NO: 129047 - DNA, 4263 bp, Homo sapiens
  Payload ID: 5240
  Gene Symbol: ENOX2
  Gene Name: ecto-NOX disulfide-thiol exchanger 2
  Uniprot ID: Q16206
  ENST ID: ENST00000338144
  CDS Start-End: 502-2334
acatttcccatgaagccatgggctcgggcctccggcttccccggtgaccagtagccaataggagacgccgcagtgggcaccctgtgtgtgagagtccagccttgggccagagtgccgggtctaggcctggaagcgcgaggcgggcatttcggaagagagtggcgcggcgtggggcgccgcgagggcactacgagcccaggaactgccgcgccggcccgattttccgcggctgtataaggactagcgcttcggtagccggggagctggagggaacctgatttgagatcaattcttggagaacacaaagaagtgtgatggattgaaccagctgccctttgaccctgctaacaacaacgagcccctgcagtttggtagtgccagtggccctctggtcacagaaggcctcattgagaatggaggggaatcaagcaagaaaagaaagagaacaaatactccttcagaaatgatgacagagctaagttcacagttgaggaccacacaatgcaaagagattttagatggctgtgggtctacgaaataggctatgcagccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgttggaaaatcttaaagaaaaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggaccattcagaaacttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctcagttttgtgtcctgtttttaatgacttacgctctaagtaatccattagtagttatctcagttccttcctttgggttactagaatgttggaaaaagatgccaagtctgtcttgacaactggaaacagggttccacagcagcccattcgtgctgaaaactggcttccccctgaagcaccctgctgtggcaccagcaggaagctcaggttaattttacactagcttgctcactgatgcatctctcatcaatgctacggaaggctttgattcatcagtctcgggctcttggaatacctaattttaataatatctatgaaatcaagggaaactttccatttacagttatttcttgtttaaataaactaaattaatttttaggggagagcagtaggaaaaagagctaatgcatgcggggtttaatacctaggtgatgggttgaggtgcagcaaaaccaccatggcacacgttcacctatgtaacaaacctgcacatcctgcacatgtaccccggaacttactt

SEQ ID NO: 129048 - DNA, 3788 bp, Homo sapiens
  Payload ID: 5240
  Gene Symbol: ENOX2
  Gene Name: ecto-NOX disulfide-thiol exchanger 2
  Uniprot ID: Q16206
  ENST ID: ENST00000370927
  CDS Start-End: 23-1855
gttcacagttgaggaccacacaatgcaaagagattttagatggctgtgggtctacgaaataggctatgcagccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgttggaaaatcttaaagaaaaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggaccattcagaaacttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctcagttttgtgtcctgtttttaatgacttacgctctaagtaatccattagtagttatctcagttccttcctttgggttactagaatgttggaaaaagatgccaagtctgtcttgacaactggaaacagggttccacagcagcccattcgtgctgaaaactggcttccccctgaagcaccctgctgtggcaccagcaggaagctcaggttaattttacactagcttgctcactgatgcatctctcatcaatgctacggaaggctttgattcatcagtctcgggctcttggaatacctaattttaataatatctatgaaatcaagggaaactttccatttacagttatttcttgtttaaataaactaaattaatttttaggggagagcagtaggaaaaagagctaatgcatgcggggtttaatacctaggtgatgggttgaggtgcagcaaaaccaccatggcacacgttcacctatgtaacaaacctgcacatcctgcacatgtaccccggaacttacttaaaa

SEQ ID NO: 129049 - DNA, 3963 bp, Homo sapiens
  Payload ID: 5240
  Gene Symbol: ENOX2
  Gene Name: ecto-NOX disulfide-thiol exchanger 2
  Uniprot ID: Q16206
  ENST ID: ENST00000370935
  CDS Start-End: 273-2018
gtgtgtgagagtccagccttgggccagagtgccgggtctaggcctggaagcgcgaggcgggcatttcggaagagagtggcgcggcgtggggcgccgcgagggcactacgagcccaggaactgccgcgccggcccgattttccgcggctgtataaggactagcgcttcggtagccggggagctggagggaacctgatttgagatcaattcttggagaacacaaagaagtgtgatgccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgttggaaaatcttaaagaaaaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggaccattcagaaacttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctcagttttgtgtcctgtttttaatgacttacgctctaagtaatccattagtagttatctcagttccttcctttgggttactagaatgttggaaaaagatgccaagtctgtcttgacaactggaaacagggttccacagcagcccattcgtgctgaaaactggcttccccctgaagcaccctgctgtggcaccagcaggaagctcaggttaattttacactagcttgctcactgatgcatctctcatcaatgctacggaaggctttgattcatcagtctcgggctcttggaatacctaattttaataatatctatgaaatcaagggaaactttccatttacagttatttcttgtttaaataaactaaattaatttttaggggagagcagtaggaaaaagagctaatgcatgcggggtttaatacctaggtgatgggttgaggtgcagcaaaaccaccatggcacacgttcacctatgtaacaaacctgcacatcctgcacatgtaccccggaacttacttaaaaaataaaagaaaa

SEQ ID NO: 129050 - DNA, 4174 bp, Homo sapiens
  Payload ID: 5240
  Gene Symbol: ENOX2
  Gene Name: ecto-NOX disulfide-thiol exchanger 2
  Uniprot ID: Q16206
  ENST ID: ENST00000394363
  CDS Start-End: 500-2245
acatttcccatgaagccatgggctcgggcctccggcttccccggtgaccagtagccaataggagacgccgcagtgggcaccctgtgtgtgagagtccagccttgggccagagtgccgggtctaggcctggaagcgcgaggcgggcatttcggaagagagtggcgcggcgtggggcgccgcgagggcactacgagcccaggaactgccgcgccggcccgattttccgcggctgtataaggactagcgcttcggtagccggggagctggagggaacctgatttgagatcaattcttggagaacacaaagaagtgtgatggattgaaccagctgccctttgaccctgctaacaacaacgagcccctgcagtttggtagtgccagtggccctctggtcacagaaggcctcattgagaatggaggggaatcaagcaagaaaagaaagagaacaaatactccttcagccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgttggaaaatcttaaagaaaaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggaccattcagaaacttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctcagttttgtgtcctgtttttaatgacttacgctctaagtaatccattagtagttatctcagttccttcctttgggttactagaatgttggaaaaagatgccaagtctgtcttgacaactggaaacagggttccacagcagcccattcgtgctgaaaactggcttccccctgaagcaccctgctgtggcaccagcaggaagctcaggttaattttacactagcttgctcactgatgcatctctcatcaatgctacggaaggctttgattcatcagtctcgggctcttggaatacctaattttaataatatctatgaaatcaagggaaactttccatttacagttatttcttgtttaaataaactaaattaatttttaggggagagcagtaggaaaaagagctaatgcatgcggggtttaatacctaggtgatgggttgaggtgcagcaaaaccaccatggcacacgttcacctatgtaacaaacctgcacatcctgcacatgtaccccggaacttactt

SEQ ID NO: 129051 - DNA, 1515 bp, Homo sapiens
  Payload ID: 5240
  Gene Symbol: ENOX2
  Gene Name: ecto-NOX disulfide-thiol exchanger 2
  ENST ID: ENST00000432489
  CDS Start-End: 387-1515
gccgggtctaggcctggaagcgcgaggcgggcatttcggaagagagtggcgcggcgtggggcgccgcgagggcactacgagcccaggaactgccgcgccggcccgattttccgcggctgtataaggactagcgcttcggtagccggggagctggagggaacctgatttgagatcaattcttggagaacacaaagaagtgtgatggattgaaccagctgccctttgaccctgctaacaacaacgagcccctgcagtttggtagtgccagtggccctctggtcacagaaggcctcattgagaatggaggggaatcaagcaagaaaagaaagagaacaaatactccttcagccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcag

SEQ ID NO: 129052 - DNA, 2422 bp, Homo sapiens
  Payload ID: 5240
  Gene Symbol: ENOX2
  Gene Name: ecto-NOX disulfide-thiol exchanger 2
  ENST ID: ENST00000610637
  CDS Start-End: 219-1010
tggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcgaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgttggaaaatcttaaagaaaaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggaccattcagaaacttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctc

SEQ ID NO: 129053 - DNA, 2035 bp, Homo sapiens
  Payload ID: 5241
  Gene Symbol: ENTPD1
  Gene Name: ectonucleoside triphosphate diphosphohydrolase 1
  Uniprot ID: P49961
  ENST ID: ENST00000371205
  CDS Start-End: 284-1816
gcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttc

SEQ ID NO: 129054 - DNA, 1903 bp, Homo sapiens
  Payload ID: 5241
  Gene Symbol: ENTPD1
  Gene Name: ectonucleoside triphosphate diphosphohydrolase 1
  Uniprot ID: P49961
  ENST ID: ENST00000371207
  CDS Start-End: 64-1632
cctgttgctctttgctctaatgagccttgagaaaggattgctggtcatgggaccagaggctttatggggagggaagaactgttcttgactttcagtttttcgagcgggtttcaagagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacc

SEQ ID NO: 129055 - DNA, 5044 bp, Homo sapiens
  Payload ID: 5241
  Gene Symbol: ENTPD1
  Gene Name: ectonucleoside triphosphate diphosphohydrolase 1
  Uniprot ID: P49961
  ENST ID: ENST00000453258
  CDS Start-End: 179-1732
gtgtacgtgtaaaattatgatcaaataaatttgtatgccttttctcctattaacctgccttttttgtcagcgattgtcagtgaaacttcagagggcaaaggggaagttttccttggcccctccagttttggtgctgtgaacaggataccaaagctgctctgttcttctggaagctgcaatgaagggaaccaaggacctgacaagccagcagaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacatggcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggagaaaaaagatcagcagaagtcattacttttttttttttttttttttttttttgagagagagtctcactccattgcccaggctggagtgcagtggtgctatctcggctcactgcaacctccgcctcctgggttcaagcaattctcctgcctcagcctcccgagtagctgggattgcaggtgcccaccaccacacccggctaatttttgtatttttagtaaagacagggtttcaccatgttggccaggctggtctccaactcccaatctcaggtgatcctattgcctcgggctcccaaagtgctgggattacaggagtgagccaccatgcctggccagaagtggttacttctgtagacaaaagaataatgctacttaatcaggctttctgtgtgacaagaaagagaaagaaaataaagaagtttcaattcatccaattcttaataagaaatatgtaaataaaattttttaaaattacacttc

SEQ ID NO: 129056 - DNA, 1579 bp, Homo sapiens
  Payload ID: 5241
  Gene Symbol: ENTPD1
  Gene Name: ectonucleoside triphosphate diphosphohydrolase 1
  Uniprot ID: P49961
  ENST ID: ENST00000543964
  CDS Start-End: 196-1404
cgagcgggtttcaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatccttt

SEQ ID NO: 129057 - DNA, 1638 bp, Homo sapiens
  Payload ID: 5241
  Gene Symbol: ENTPD1
  Gene Name: ectonucleoside triphosphate diphosphohydrolase 1
  ENST ID: ENST00000635076
  CDS Start-End: 62-217
gcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattg

SEQ ID NO: 129058 - DNA, 773 bp, Homo sapiens
  Payload ID: 5241
  Gene Symbol: ENTPD1
  Gene Name: ectonucleoside triphosphate diphosphohydrolase 1
  ENST ID: ENST00000483213
  CDS Start-End: 278-469
tctcacggagacggaccacagcaagcagaggctgggggggggaaagacgaggaaagaggaggaaaacaaaagctgctacttatggaagatacaaaggtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagacccc

SEQ ID NO: 129059 - DNA, 1119 bp, Homo sapiens
  Payload ID: 5242
  Gene Symbol:
  Gene Name: Ectonucleoside triphosphate diphosphohydrolase 1 [Source:UniProtKB/Swiss-Prot Acc:P49961]
  Uniprot ID: P49961
  ENST ID: ENST00000539125
  CDS Start-End: 1-1119
atggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatag

SEQ ID NO: 129060 - DNA, 1500 bp, Homo sapiens
  Payload ID: 5243
  Gene Symbol: ENTPD2
  Gene Name: ectonucleoside triphosphate diphosphohydrolase 2
  Uniprot ID: Q9Y5L3
  ENST ID: ENST00000312665
  CDS Start-End: 22-1440
ctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagcagctgctgagtcgcggctacggcttcgacgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactc

SEQ ID NO: 129061 - DNA, 2095 bp, Homo sapiens
  Payload ID: 5243
  Gene Symbol: ENTPD2
  Gene Name: ectonucleoside triphosphate diphosphohydrolase 2
  Uniprot ID: Q9Y5L3
  ENST ID: ENST00000355097
  CDS Start-End: 49-1536
ccgcactctccgggtccacgcatcgtcctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagctgcaagctcgggtgccagggcaacgggcccgcctggccgactactgcgccggggccatgttcgtgcagcagctgctgagtcgcggctacggcttcgacgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactcccacccctcccacaacccctgtacctcccacccctgtatccccacccctccacccacccctctcccaacctctctccccgcccctgtatcctgcattcctccacccaccctctatcccccaccgctccaccccaccactgtcttctccatccttccaccccaccctcagcgtctctgcccctaaggcagcccaggaaataggaactgagactctggtacccacaggagcctgggtgggcaaagagcgctcaatccagctccttgaacccctccagcccgcttcagcctgggcatcactgcaggccccgtgctcctcctcctcctcctcagggctgggtctccagagagtggggccttggtcctgagaatcagcccttagaggctccttctgtgtagtctgggtctgtactggggagggtcacagcccacgggctggcagccagcccagcacctacttgtaaaaattttgtaataaaaagtttttcctagagacgtgaaa

SEQ ID NO: 129062 - DNA, 2819 bp, Homo sapiens
  Payload ID: 5244
  Gene Symbol: ENTPD3
  Gene Name: ectonucleoside triphosphate diphosphohydrolase 3
  Uniprot ID: O75355
  ENST ID: ENST00000301825
  CDS Start-End: 119-1708
atacccggcgccgcctcccggcgtctgagctgacacctccttagcgctggccgcgggccgcctctgcggcagcgctagtcgccttctccgaatcggctccgcacagctaggagaaaagatgttcactgtgctgacccgccaaccatgtgagcaagcaggcctcaaggccctctaccgaactccaaccatcattgccttggtggtcttgcttgtgagtattgtggtacttgtgagtatcactgtcatccagatccacaagcaagaggtcctccctccaggactgaagtatggtattgtgctggatgccgggtcttcaagaaccacagtctacgtgtatcaatggccagcagaaaaagagaataataccggagtggtcagtcaaaccttcaaatgtagtgtgaaaggctctggaatctccagctatggaaataacccccaagatgtccccagagcctttgaggagtgtatgcaaaaagtcaaggggcaggttccatcccacctccacggatccacccccattcacctgggagccacggctgggatgcgcttgctgaggttgcaaaatgaaacagcagctaatgaagtccttgaaagcatccaaagctacttcaagtcccagccctttgactttaggggtgctcaaatcatttctgggcaagaagaaggggtatatggatggattacagccaactatttaatgggaaatttcctggagaagaacctgtggcacatgtgggtgcacccgcatggagtggaaaccacgggtgccctggacttaggtggtgcctccacccaaatatccttcgtggcaggagagaagatggatctgaacaccagcgacatcatgcaggtgtccctgtatggctacgtatacacgctctacacacacagcttccagtgctatggccggaatgaggctgagaagaagtttctggcaatgctcctgcagaattctcctaccaaaaaccatctcaccaatccctgttaccctcgggattatagcatcagcttcaccatgggccatgtatttgatagcctgtgcactgtggaccagaggccagaaagttataaccccaatgatgtcatcacttttgaaggaactggggacccatctctgtgtaaggagaaggtggcttccatatttgacttcaaagcttgccatgatcaagaaacctgttcttttgatggggtttatcagccaaagattaaagggccatttgtggcttttgcaggattctactacacagccagtgctttaaatctttcaggtagcttttccctggacaccttcaactccagcacctggaatttctgctcacagaattggagtcagctcccactgctgctccccaaatttgatgaggtatatgcccgctcttactgcttctcagccaactacatctaccacttgtttgtgaacggttacaaattcacagaggagacttggccccaaatacactttgaaaaagaagtggggaatagcagcatagcctggtctcttggctacatgctcagcctgaccaaccagatcccagctgaaagccctctgatccgtctgcccatagaaccacctgtctttgtgggcaccctcgctttcttcacagcggcagccttgctgtgtctggcatttcttgcatacctgtgttcagcaaccagaagaaagaggcactccgagcatgcctttgaccatgcagtggattctgactgagccttcaaagcagctcctggagtccaatggctgcttagagtcagcctgggtggcaccaggcaatgcaggtgaagtggctgccttcaggaaatacaactaactaaaatcaaacacctaggtcacgtgcctctcaaatactgatttctgccacagcacctcttgaggcatcccttggctattctgtgcatattgttcttcagagacctcactacccacatgctgatctattggggaacagagaagagacaggccacgaaggtcaggctctttatattaagttccccagaggaagagtaagttgagaaggtatcagtttaatgttgaagaattgacctcagggctcagtttccatttccctccctcagtattcttcctggcaagatacccattaagcatttcgccaatcagaatctcattttatagtttttcccattggtctttaactaagactttcttgtagcaatctcgtaagcagtgaaccccctcagatcagtagaatatagtatctgggggagaagacttacttccttcagggcagcagccacagccaggcttctgtcatacaggtagatcccgaagcacagagacataaaaaaggtctcccagaaaactatagaccattctccaagtggaattcccacttagggctctggtcactagattgcaacctgtgtgtttgtcatcatcctcatctcaccattgtattgctatgccctcccataaaaacacattgatccctagcaagattattgcattccagattttactgcctttgctaggcttttgcttagcaaagggctgactttccattgttatcatggtgtatatatttttgtcaccattcccacaagtatacttgatgttgtcatagaacgaacatcctactctatgatttactaaccaattactttcccagatcatagacctctctgcatagtagtcataggtcttgactttggggaaagaaaaggaagctgcaggaatatttatctccaaagtcgaatgagaaagaactccagcaaatccaatggctacaaactaaaaatcagcattatttcatattgctgtttcttagctgaatatggaataaagaactattattttattttga

SEQ ID NO: 129063 - DNA, 1749 bp, Homo sapiens
  Payload ID: 5244
  Gene Symbol: ENTPD3
  Gene Name: ectonucleoside triphosphate diphosphohydrolase 3
  Uniprot ID: O75355
  ENST ID: ENST00000456402
  CDS Start-End: 160-1749
gaatcggctccgcacaggtaagatcaggggacccggcgcctgagctgccgaggaaggagtcgggggtgctgcgtgagactgagagttgggaggcaaagaaacaaaatcggatttcctcagagggccagaggaagagactgaaacacgctaggagaaaagatgttcactgtgctgacccgccaaccatgtgagcaagcaggcctcaaggccctctaccgaactccaaccatcattgccttggtggtcttgcttgtgagtattgtggtacttgtgagtatcactgtcatccagatccacaagcaagaggtcctccctccaggactgaagtatggtattgtgctggatgccgggtcttcaagaaccacagtctacgtgtatcaatggccagcagaaaaagagaataataccggagtggtcagtcaaaccttcaaatgtagtgtgaaaggctctggaatctccagctatggaaataacccccaagatgtccccagagcctttgaggagtgtatgcaaaaagtcaaggggcaggttccatcccacctccacggatccacccccattcacctgggagccacggctgggatgcgcttgctgaggttgcaaaatgaaacagcagctaatgaagtccttgaaagcatccaaagctacttcaagtcccagccctttgactttaggggtgctcaaatcatttctgggcaagaagaaggggtatatggatggattacagccaactatttaatgggaaatttcctggagaagaacctgtggcacatgtgggtgcacccgcatggagtggaaaccacgggtgccctggacttaggtggtgcctccacccaaatatccttcgtggcaggagagaagatggatctgaacaccagcgacatcatgcaggtgtccctgtatggctacgtatacacgctctacacacacagcttccagtgctatggccggaatgaggctgagaagaagtttctggcaatgctcctgcagaattctcctaccaaaaaccatctcaccaatccctgttaccctcgggattatagcatcagcttcaccatgggccatgtatttgatagcctgtgcactgtggaccagaggccagaaagttataaccccaatgatgtcatcacttttgaaggaactggggacccatctctgtgtaaggagaaggtggcttccatatttgacttcaaagcttgccatgatcaagaaacctgttcttttgatggggtttatcagccaaagattaaagggccatttgtggcttttgcaggattctactacacagccagtgctttaaatctttcaggtagcttttccctggacaccttcaactccagcacctggaatttctgctcacagaattggagtcagctcccactgctgctccccaaatttgatgaggtatatgcccgctcttactgcttctcagccaactacatctaccacttgtttgtgaacggttacaaattcacagaggagacttggccccaaatacactttgaaaaagaagtggggaatagcagcatagcctggtctcttggctacatgctcagcctgaccaaccagatcccagctgaaagccctctgatccgtctgcccatagaaccacctgtctttgtgggcaccctcgctttcttcacagcggcagccttgctgtgtctggcatttcttgcatacctgtgttcagcaaccagaagaaagaggcactccgagcatgcctttgaccatgcagtggattctgactga

SEQ ID NO: 129064 - DNA, 1658 bp, Homo sapiens
  Payload ID: 5244
  Gene Symbol: ENTPD3
  Gene Name: ectonucleoside triphosphate diphosphohydrolase 3
  Uniprot ID: O75355
  ENST ID: ENST00000445129
  CDS Start-End: 62-1420
gaggccggggcggtggacttactgacatcctgtattctctcacctgcagctaggagaaaagatgttcactgtgctgacccgccaaccatgtgagcaagcaggcctcaaggccctctaccgaactccaaccatcattgccttggtggtcttgcttgtgagtattgtggtacttgtgagtatcactgtcatccagatccacaagcaagaggtcctccctccaggactgaagtatggtattgtgctggatgccgggtcttcaagaaccacagtctacgtgtatcaatggccagcagaaaaagagaataataccggagtggtcagtcaaaccttcaaatgtagtgtgaaaggctctggaatctccagctatggaaataacccccaagatgtccccagagcctttgaggagtgtatgcaaaaagtcaaggggcaggttccatcccacctccacggatccacccccattcacctgggagccacggctgggatgcgcttgctgaggttgcaaaatgaaacagcagctaatgaagtccttgaaagcatccaaagctacttcaagtcccagccctttgactttaggggtgctcaaatcatttctgggcaagaagaaggggtatatggatggattacagccaactatttaatgggaaatttcctggagaagaacctgtggcacatgtgggtgcacccgcatggagtggaaaccacgggtgccctggacttaggtggtgcctccacccaaatatccttcgtggcaggagagaagatggatctgaacaccagcgacatcatgcaggtgtccctgtatggctacgtatacacgctctacacacacagcttccagtgctatggccggaatgaggctgagaagaagtttctggcaatgctcctgcagaattctcctaccaaaaaccatctcaccaatccctgttaccctcgggattatagcatcagcttcaccatgggccatgtatttgatagcctgtgcactgtggaccagaggccagaaagttataaccccaatgatgtcatcacttttgaaggaactggggacccatctctgtgtaaggagaaggtggcttccatatttgacttcaaagcttgccatgatcaagaaacctgttcttttgatggggtttatcagccaaagattaaagggccatttgtggcttttgcaggattctactacacagccagtgctttaaatctttcaggtagcttttccctggacaccttcaactccagcacctggaatttctgctcacagaattggagtcagctcccactgctgctccccaaatttgatgaggtatatgcccgctcttactgcttctcagccaactacatctaccacttgtttgtgaacggttacaaattcacagaggagacttggccccaaatacactttgaaaaagaagaatagctgatatgaagcctgaaggatgtctggagtcagcctgttcaataccagcttcagcaataattagattaaaccaatcaatatcctgcattaggcctctgactatctacttttacataaataaaattgagtcatctacaaaaaaataaggatgtctggagacataaggactgttggtagcatgtactctctaagctttgcttctaataaatctaattaccagtaaagtatattataagaa

SEQ ID NO: 129065 - DNA, 551 bp, Homo sapiens
  Payload ID: 5244
  Gene Symbol: ENTPD3
  Gene Name: ectonucleoside triphosphate diphosphohydrolase 3
  ENST ID: ENST00000439533
  CDS Start-End: 160-551
gaatcggctccgcacaggtaagatcaggggacccggcgcctgagctgccgaggaaggagtcgggggtgctgcgtgagactgagagttgggaggcaaagaaacaaaatcggatttcctcagagggccagaggaagagactgaaacacgctaggagaaaagatgttcactgtgctgacccgccaaccatgtgagcaagcaggcctcaaggccctctaccgaactccaaccatcattgccttggtggtcttgcttgtgagtattgtggtacttgtgagtatcactgtcatccagatccacaagcaagaggtcctccctccaggactgaagatagggtttcaccgtgttgaccaggctagtcttgaactcctgacctcaggtgatccacccacctcagcctcccagagtggtgggattataagcatgagccaccgtgcccagccgcaactaagatatggtattgtgctggatgccgggtcttcaagaaccacagtctacgtgtatcaatggccagcagaaaaagagaataataccggagtggtcagtcaaacctt

SEQ ID NO: 129066 - DNA, 2097 bp, Homo sapiens
  Payload ID: 5245
  Gene Symbol: ENTPD4
  Gene Name: ectonucleoside triphosphate diphosphohydrolase 4
  ENST ID: ENST00000356206
  CDS Start-End: 237-1952
gcaggcggtgacgtgttgccggcgggggccgggcgggggtgcggctccaggaaaggagcgcggcctccaggaagccggctggccgtgatgctgcccactggtggtcccccgctcccggggtccccggccggccaagcaggagggctctaactccgtgaggaccccagcattatttctataattgtttgtgagaaggactgaatcccagagcattgccttgttgctgacctttcagtatggggaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatgatgatgaggccgttgtggaagttaacattcctggaagtgaaagcagcgaagccattgtccgtaaaaggacagcgggcattctcgacatgggcggcgtgtcgactcagatagcgtacgaagtccccaaaactgaagaagtagctaaaaacttgttagctgaatttaacttgggatgtgatgttcaccaaactgagcatgtgtatcgagtctatgtggccacgtttcttgggtttggtggcaatgctgctcgacagagatacgaagacagaatatttgccaacaccattcaaaagaacaggctcctgggtaaacagactggtctgactcctgatatgccgtacttggacccctgcctacccctagacattaaagatgaaatccagcaaaatggacaaaccatatacctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaaggaaaatagggatgctgataataccttgctcagggggttgtccaaagctgtgttgtgcagtatggcagccaccaccatatggggccaccaaacacttgcaatgtgctgcttggaattgagatgcgctgcaaacgcaaagtacgtgctggatttcaaagacttagtacaaaaagaaaaaagaacgcaaaacatctcattaataatttttgtattgattccatattgaaatatattgcatcaaataaaatatatctttaacattga

SEQ ID NO: 129067 - DNA, 5861 bp, Homo sapiens
  Payload ID: 5245
  Gene Symbol: ENTPD4
  Gene Name: ectonucleoside triphosphate diphosphohydrolase 4
  Uniprot ID: Q9Y227
  ENST ID: ENST00000358689
  CDS Start-End: 237-2087
gcaggcggtgacgtgttgccggcgggggccgggcgggggtgcggctccaggaaaggagcgcggcctccaggaagccggctggccgtgatgctgcccactggtggtcccccgctcccggggtccccggccggccaagcaggagggctctaactccgtgaggaccccagcattatttctataattgtttgtgagaaggactgaatcccagagcattgccttgttgctgacctttcagtatggggaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatgatgatgaggccgttgtggaagttaacattcctggaagtgaaagcagcgaagccattgtccgtaaaaggacagcgggcattctcgacatgggcggcgtgtcgactcagatagcgtacgaagtccccaaaactgtaagctttgcgtcctcacagcaggaagaagtagctaaaaacttgttagctgaatttaacttgggatgtgatgttcaccaaactgagcatgtgtatcgagtctatgtggccacgtttcttgggtttggtggcaatgctgctcgacagagatacgaagacagaatatttgccaacaccattcaaaagaacaggctcctgggtaaacagactggtctgactcctgatatgccgtacttggacccctgcctacccctagacattaaagatgaaatccagcaaaatggacaaaccatatacctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaagagacatccagcaggaggccttccgagccagtcacacccactggcggggcgtttcctttgtctacaaccactacctgttctctggctgcttcctggtggtgctgctggccatcctgctgtacctgctgcggctgcggcgcatccacaggcgcactccccggagcagctcggccgccgccctctggatggaggagggccttcccgcccagaatgccccggggaccttgtgatccagctcacagctccacgaagactcaaaaggaaaagccatttttgcctcagggtttctcctctttattttcctgtggttttgttttttctttcccttttttgttcctccaaacaaaaacaaaatgcaggccgagcgcggtggctcacgcctgtaatcccagcactttgggaggccgaggcgggcggatcatgaggtcaggagatcgagaccatcctggctaacacggtgaaaccccgtctctactaaaaatacaaaaaattagctgggtgtggtggcgggcgcccgtagtcccagctactcaggaggctgaggcaggagaatggcatgaacctgggaggcagagcttgcagtgagccgagatcacaccactgcactccagcctgggcgacagagtgagactccgtctcaaaaaaaaaaaatgcattgtttataagccctgctgtctagaagtattgcgtttagccattttgagtacagcattaaattgaggagtggggaagagggaaattcacttgatttttgctgcacaggatatctgccaaaaataaatgagatttctggggtttctctaaggaatgttaaatttaaacacatgcactttgatactggagggaggtggaaagatgcattctgtcagtggagaggggactgaatagtgatgctttcatagaaccaaaaaacttactgcctgaaatgataatcctcttttttctctatcttgaaagctctaacctgaagagggtgatttttttttttatttattgttcaggtctgttactgtatatgttttctttgcaaatttaaattttttaaaccatttatatccaaaacagagaaacatgggcaccaggagataaccatttataaaagtgatagtgaactatcgactacagctttgtgcgagtgtgtgaaaaatcccaagaaaccagcgtgaggggaggcaatgctggttctttaaaaacacacacttcagaatttactggtacattttatttagaaaaatcctcgttactgttatcttttcctgaccgcaggtaattacgctccttattccatatttcagtggcattagaacactgtggttttgaaagaattggaaattcctagtttcaccagtttcggttttattggaactagagcacatgcccacttcttgctcagtattcctcagtgtttctgcttaatcgtgcctcagtttcttccagcttccaattggtgtttcccccaccccccttaattaaaagtcatctcagcttttaatcgtactgggagaccccatgcacagcctgccgagtcctcttcctaaccgcattgactgaggctgttgctggcagcaccactgtaaatccagaagggaagagtctgcatccaatacaggaaataaattcacattttgaaggaaaaaattcgacaatttaagccaaaatctaaaaaggacaattggattggcatatgtgagattggtgttttttcacctatttatttagttgagaagtttggggaattctcgtacagtttttttaggtggagtttgttttgtgcgagtgtctgtgtgtgctgttccctaactccagaacagttaaattcctgtagttggtagcagattagtacccagaagtggggttgttgctataacagataactgaggatattataaaagtggctttggaactaggtactgggcagaggctgggagagtttggagaaacaggagagaaaaggcctgtattgccatgaactgagcattaggggcagttctgctgagggatcagaagagaagaccaagggaattctgtcccagttgtggctcaaactgcctcaggtgcagcttaacctgcgtctctggaaggtaaaatgcatctgatccttgaggcaagagctgtgggggcatggctccctcacctggatttcaaagcgtgttaccagcagcctggggacccaggctctgcctctggatttacctgcatcgtatttgcgcttcgtggtcaaagttgttaagaaaggggtgagcttctggctacctaataagttggtcttggccacctgcctgcgacacttcctggaggagccatggattattggtggaggctgcagggagctggcgatggagccactggtgtcagcagcagagagggaagaaaggaaaggaaggggccacaaatggttgaagtgggcaggtgggcacccagggagttaggggaccccgccttccagctctgggcatagaagagttagtcacatacctgaggatcctgaaacaagggctgagaaaacctcattgctccagctgagaggtagtagtggatttgccatttttaaacagttgcctaagaaaaaacgttgaagaatatgcagcagacactatatgtggcctgtaaagcctagaatatttactaaaatatttacagaaaaagtttgctggtccttgtgagaacaatgcagttcaaaaaaggatacagacagaagcatcctcttaaatcaggaatgtagtttccatttgtgggcacgaaaagatggacaagagaagtaaccaaacttcaatcttaaaatatttgttgcaccagaatttcacttcggatttttccgtctagattattttcaagatgagttttgaaacaaaccaagaaacctgcccctcacccaaaattgtttaaaaagagaccactcaagggagttcattatgccgtatggagatgtctgcagtcgcagcaaatcacattccagagaaggtctcgcgtaggtgaagacagccaggtgctttctctaagagatacagggtgggtgagagacaagccagggaggatcttaattcaagagaagaattcataccaagagctgaccaagaaggcagtaaattctgtgtacttgtagcagaagaaattggactaggaacttgcccaaagctttatcaaagaaaagcattgtgttcaatcttggtagaaacatgccagcaataagtgcttatgttccatagccatatcatgggcttctcacttttaaacctcctccaggggatgttctcagacatttcacaatccctctggggacattacagtagaagagaaacacatggaactgtaccagtgctttttgcccatgttcatcctaagctccggctttaggcagtgctttctgacctgggcggagtgaagacgctgctggtggctgaggccagtaacatggggcccctgcccagccaccctgaaggctgggtaggtccctcttttcaccaccagttttccacatctgtgtactctagattaacaaactctggataaacagatatttacattttaaactcaggcctacacagagtagttttccttataaggagcatgtatcacttagcaagaaactaaaaatggcaaatgagtttttcatcctttaagaaaaaaatcagctttagaattctctgcggtcagttgtgtgcaatgcaacaaaactacctttcagtaaattacttagttatttatttcagtgttttgtttcttttgatactaagtttccctttcaataatgaatgatgtgaccaaccaaggagaatttgtttgttctgtactaaaattatattttacagttaggaattataaaaagcaagggagcatctttaaatgttttttgtttaagcgatgtcttccatccaaagtaagaataatactctcggaaggtccttttggtgtcatgtcacttgctgtatgtggcagccttacagtgccacacttgggtactgaaaaatcaataaaacgaaagttcatcatcccatggcccgtag

SEQ ID NO: 129068 - DNA, 2063 bp, Homo sapiens
  Payload ID: 5245
  Gene Symbol: ENTPD4
  Gene Name: ectonucleoside triphosphate diphosphohydrolase 4
  Uniprot ID: Q9Y227
  ENST ID: ENST00000417069
  CDS Start-End: 237-2063
gcaggcggtgacgtgttgccggcgggggccgggcgggggtgcggctccaggaaaggagcgcggcctccaggaagccggctggccgtgatgctgcccactggtggtcccccgctcccggggtccccggccggccaagcaggagggctctaactccgtgaggaccccagcattatttctataattgtttgtgagaaggactgaatcccagagcattgccttgttgctgacctttcagtatggggaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatgatgatgaggccgttgtggaagttaacattcctggaagtgaaagcagcgaagccattgtccgtaaaaggacagcgggcattctcgacatgggcggcgtgtcgactcagatagcgtacgaagtccccaaaactgaagaagtagctaaaaacttgttagctgaatttaacttgggatgtgatgttcaccaaactgagcatgtgtatcgagtctatgtggccacgtttcttgggtttggtggcaatgctgctcgacagagatacgaagacagaatatttgccaacaccattcaaaagaacaggctcctgggtaaacagactggtctgactcctgatatgccgtacttggacccctgcctacccctagacattaaagatgaaatccagcaaaatggacaaaccatatacctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaagagacatccagcaggaggccttccgagccagtcacacccactggcggggcgtttcctttgtctacaaccactacctgttctctggctgcttcctggtggtgctgctggccatcctgctgtacctgctgcggctgcggcgcatccacaggcgcactccccggagcagctcggccgccgccctctggatggaggagggccttcccgcccagaatgccccggggaccttgtga

SEQ ID NO: 129069 - DNA, 351 bp, Homo sapiens
  Payload ID: 5245
  Gene Symbol: ENTPD4
  Gene Name: ectonucleoside triphosphate diphosphohydrolase 4
  ENST ID: ENST00000519839
  CDS Start-End: 1-351
tatttgtttactgctggccaaggcataatggcaatccacatgatctgttggatatcaggcaaatgagggataaaaaccgaaagccagtggtcatgaagataaaaccggagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatg

SEQ ID NO: 129070 - DNA, 566 bp, Homo sapiens
  Payload ID: 5245
  Gene Symbol: ENTPD4
  Gene Name: ectonucleoside triphosphate diphosphohydrolase 4
  ENST ID: ENST00000518718
  CDS Start-End: 186-566
aggaaaggagcgcggcctccaggaagccggctggccgtgatgctgcccactggtggtcccccgctcccggggtccccggccggccaagcaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgca

SEQ ID NO: 129071 - DNA, 790 bp, Homo sapiens
  Payload ID: 5245
  Gene Symbol: ENTPD4
  Gene Name: ectonucleoside triphosphate diphosphohydrolase 4
  ENST ID: ENST00000518471
  CDS Start-End: 1-645
acaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaagccatcggagaccagagccgccccctctgctcgagaaaggggctcagcggcggcggaagcggagggggaccaccgtggagagcgcggtcccagcccggccactgcggatccctgaaaccaagaaaatagggatgctgataataccttgctcagggggttgtccaaagctgtgttgtgcagtatggcagccaccaccatatggggccaccaaacacttgcaatgtgctgcttggaattgagatgcgctgcaaacgcaaagtacgtgctggatttcaaagacttagtacaaaaagaaaaaagaacgcaaaacatctcattaataatttttgtattgattccatattgaaatatattgcatcaaataaaatatatctttaacattga

SEQ ID NO: 129072 - DNA, 5842 bp, Homo sapiens
  Payload ID: 5246
  Gene Symbol: ENTPD5
  Gene Name: ectonucleoside triphosphate diphosphohydrolase 5
  Uniprot ID: O75356
  ENST ID: ENST00000334696
  CDS Start-End: 321-1607
tagcccaggcgccgcggcgcgcggggtggggcggaggtcgcgccgagggcggcgggctgccgcgcaagggtggcgcgcgcgcgttttccttgttcctggtcaacaaagaaatgtggagtgtcttggctgaatcctcatacagacaagatcattatggtgctgttaggtaggacttgtatccagatgtaaggttgaaaaagtgatataataaaggaaccaaggagaaaattcagaaggaaagaaaaaattgcctctgcaggtgtgcgagcaggattgcttctgcaacaaaagcctccacccagccacatcttgggaaaagaatggccacttcttggggcacagtctttttcatgctggtggtatcctgtgtttgcagcgctgtctcccacaggaaccagcagacttggtttgagggtatcttcctgtcttccatgtgccccatcaatgtcagcgccagcaccttgtatggaattatgtttgatgcagggagcactggaactcgaattcatgtttacacctttgtgcagaaaatgccaggacagcttccaattctagaaggggaagtttttgattctgtgaagccaggactttctgcttttgtagatcaacctaagcagggtgctgagaccgttcaagggctcttagaggtggccaaagactcaatcccccgaagtcactggaaaaagaccccagtggtcctaaaggcaacagcaggactacgcttactgccagaacacaaagccaaggctctgctctttgaggtaaaggagatcttcaggaagtcacctttcctggtaccaaagggcagtgttagcatcatggatggatccgacgaaggcatattagcttgggttactgtgaattttctgacaggtcagctgcatggccacagacaggagactgtggggaccttggacctagggggagcctccacccaaatcacgttcctgccccagtttgagaaaactctggaacaaactcctaggggctacctcacttcctttgagatgtttaacagcacttataagctctatacacatagttacctgggatttggattgaaagctgcaagactagcaaccctgggagccctggagacagaagggactgatgggcacactttccggagtgcctgtttaccgagatggttggaagcagagtggatctttgggggtgtgaaataccagtatggtggcaaccaagaaggggaggtgggctttgagccctgctatgccgaagtgctgagggtggtacgaggaaaacttcaccagccagaggaggtccagagaggttccttctatgctttctcttactattatgaccgagctgttgacacagacatgattgattatgaaaaggggggtattttaaaagttgaagattttgaaagaaaagccagggaagtgtgtgataacttggaaaacttcacctcaggcagtcctttcctgtgcatggatctcagctacatcacagccctgttaaaggatggctttggctttgcagacagcacagtcttacagctcacaaagaaagtgaacaacatagagacgggctgggccttgggggccacctttcacctgttgcagtctctgggcatctcccattgaggccacgtacttccttggagacctgcatttgccaacacctttttaaggggaggagagagcacttagtttctgaactagtctggggacatcctggacttgagcctagagatttaggtttaattaattttacacatctaatgtgaactgctgcctaaccactcaagagtacacagctggcaccagagcatcacagagagccctgtgagccaaaaagtatagttttggaacttaaccttggagtgagagcccagggacaggtccctggaaaccaaagaaaaatcgcatttcaaccctttgagtgcctcattccactgaatatttaaattttcctcttaaatggtaaactgacttattgcaatcccaagacccatcaatatcagtatttttttcctccctatacagtgccctgcccacccttatctgcacccacctcccctgaaaaagagagaaaaaaaaaaacctggttttgctttccatgtataattcaacaacgcaaaatgggaccatgtcagaatctgtatgatcctattctgtgttagctccaatcagccagctgagagccatcctaaatattaataggatgagagagtaactcctaactgtgcataaattacagccttaagaaagaaggccacccggtctctggggacatgttttgggagggtgtggctgcctcatatagcctacctttgctttaatcagcattttatcagtcaactctgggattaatgaacatatccgactttatgggtatgtgtatattcagtgccagtaccacctcccaggctaatgtgttaacagtgttttctatgattctaaacttgttttctttgtatttctaagaaatacaactaggccctaacttttggtctgtggtcagaggtcagtgtctgtgctattccaggatctattatttcagtttgcccttttattctctccgtttgtaacagtaccttcctgtcctggtccctgatcactttagctaatatcctttgaattatttatctagttcagagtttccaataccgttcctgacaaaaccccacttggatttggttggctctctcagcccacatcagtacagtggaccaacatttccagggagaaccatatttaatgtccctcatgctctctttttgaatccaagtgctcagagctcttgactgtgaattatttaccccaaattcattatcttgcacttttttttgagatggagtcttgctctgttgctcaggctagagtggagtggcgcaatctcagctcactgcaacctccgcccccaggttcaagcgattcttgttctcagcctcctgaagagctgggattacaggtgcccaccaccattcctggctaatttttgtatttgtagtagagatggggtttcaccatgttggccaggctggtttccaactcctgatctcaattgatccacccgcttcccaaagtgctgggattacaggcatgagacaccgcgcctggccttatcttgcactttcaacataatcatccctgcttctcatctgccctgcagtgctcttggacctggaagatctccctgtggtctggcccctttgccttggttgttaacctccagcttctttgcaggagtgtatttccccaaaacttgtggctttcacagtagactccgtttccatcctctctctcacaaaggatgttaagtatgcctggccctcacacagtccatgggaaaccttatttttaacattactccattgagtcaataaatatttaccatctgctgtgtgcaagttactaggcaaatttctgtatccttgtccctaaaattcttgtctttaaattcattgtggaatttctttagacttcacactgacttttattactaaggtcacctttataccaactgccttcctcaaaatgcttataatgaaataacagaatcttgagttggaaacagcccaaagaaataatccaatgttgtactcagtgcagaattccctagaatttctaacaggttgtcattcagcttctgctaagccatgttcaaacagcttattccatttggaactgcactgatattaaaaaaaattccttatattgagctgaaatctacctatcttctaagtggtcttagttctgctctaatctctccttccaaaatctttggatcttttgaaaaaagttcctcccaagttcttttataagtgacatgacttttagaccccttcccatctttgtcaacaaaagtagggtgccagaccagtcacagaacactaaatgtcatccatgtttccttcagtagaaaccagcagttttaaaagaggtaagctgtgttcactaaagactgttccagcttgacaaatgcagagatataagtctctggtctttaatcactgtgggggccattttgtaaaacacacatactgtccagcagactcctttggtcatcccaaatacctctgaactccagggaagatgcattctaactccacgaacttacctattttgttaaccttgattagaccttctggagaagtaaccaatttgtccatcttaggagcaatttggaatgagagtttttatttttttctgtaacgcccatcctgcctgcagtagaccctttgggcttaagaggtcctacagattctaatagtttcctctttgtagatgtgttaacatatttaaaatacttaggacatggcctggtacgtgacagatggtgtttaacatcattgtcatatgaagaacactctctgtgggccaatggaggtgtgccttaaaattcttcatcttgcctgattttgtttgcataacttctggagagtctgtgtcctcctcatctaggccacctttccattttttgtgaaagatgaccttgtccctgcagtctccgccaggagtcacacagcttttcacagcagctgccatctttaattctttttcctgagattccagcaaggttgtgacattgtcacttttttgttctagactcttttaaattttctgcatttgcctgaaaagcacccctgtaagaatagatttctcatggctctaaaaattattcccaagaataccttacttggttcaaaagcagactgtttctcttcatttcatctcaaatcagacttctgggcaagatgttctttagagtaagcaaacctacaacctaaaaatctcttcaagaggcatctctggtcttgtgacgagacctcttcaaaaacccacagtaaaactcccctccctccagttggccaccagtctgccaccaaacatgaacaaattctgctgctaatcggtttcccttgtgatctggttcctgaggtcttcggatctgtgcaatgaattatttattgttttattaaaccgacagtggtgtcccagagaggaaccataaataaaatggaaatctggtgctgtgataaagtaataactagcattaatgagacctggttttcctttcagaaagtccagtatacctgtaacaaaggttaaagcaatttatatttaatttgcattctgatgttaacatttaaacagcaattctaacaaaaatgcatcgagtctaattcttacctctatcaaaaaacaactgtataaatttatgaccaacattaaaacaaaaacaaaatgtaaattttctctttagaaatgattaactggaaatgagtgagacagcaccttgtgggttttttagtaataaaaagctcttttcaaccaaattgtaagtcttccttcgaagttttttcctttggtctggctaatatacgctcctcacagcaaattatcattcattatttgggtgccacaggcccattaagcaaagaagaaaaagagaattttaatgtaaagtaagtttattaaattaaataagatcttgaaaatatgtatgatgggtcctgggcaggatgttctttttcatcaacgtaatctttctttaggagaggagtactcatttgcttgcaaaggccataatctgttcctggagaaaaaataaaagtgaatgaaactcttaacacagtaaggtgaagaaaataattattgtagataataatcacgtaggtattcttcccaagtgtccttgttttatttcagctaaaaaaagaaaaatatacatacatatacacacgttttagagacagggtctcactctgttgactgggctggagtgcagtggtgtgatcatagctcactgcagcctcaaactcctaggctcaagcaatcctccctccccagcctcctataaagtgctgggatta

SEQ ID NO: 129073 - DNA, 1437 bp, Homo sapiens
  Payload ID: 5246
  Gene Symbol: ENTPD5
  Gene Name: ectonucleoside triphosphate diphosphohydrolase 5
  ENST ID: ENST00000556242
  CDS Start-End: 299-574
ggggtggggcggaggtcgcgccgagggcggcgggctgccgcgcaagggtggcgcgcgcgcgttttccttgttcctggtcaacaaagaaatgtggagtgtcttggctgaatcctcatacagacaagatcattatggtgctgttaggtaggacttgtatccagatgtaaggttgaaaaagtgatataataaaggaaccaaggagaaaattcagaaggaaagaaaaaattgcctctgcaggtgtgcgagcaggattgcttctgcaacaaaagcctccacccagccacatcttgggaaaagaatggccacttcttggggcacagtctttttcatgctggtggtatcctgtgtttgcagcgctgtctcccacaggaaccagcagacttggtttgagggtatcttcctgtcttccatgtgccccatcaatgtcagcgccagcaccttgtatggaattatgtttgatgcagggagcactggaactcgaattcatgtttacacctttgtgcagaaaatgccaggtcacttatggagcctggggaaaggtggaggagttaggtgtccaccagagaaatggtagcagaaatggaccctcagaggttgctctagtccttctttccagtactcctgcaagacattcctcacaactaggatcatttgggataacttcagggaagtcataggaaaacttacagagacagagcccagcatctgaagcagcctaacttttggtaaccagctctctcttctgttttgttccatggacaaaataggacagcttccaattctagaaggggaagtttttgattctgtgaagccaggactttctgcttttgtagatcaacctaagcaggtgagtttcttatgatttgatgtttagattctcaatgccttgataacttgaccacaccactgctgttaaatatttcatgctattcactaatgagattgagatcatgtgtgagatcagctttctctcctcagctaatctcctggataaaattaattacatttcccacgctcatgagggctgggtggaagaaggctagaaaattggttgtggtaatgcaaggatgacactagcttttaagagattactccctatgtacttactgtttaaaattttgagttgaagccatcagttgtatttgttcatgtaagcgcagaagataaacatgaagttctgtagggtatgatgtataaacatggcagttgaaggcatggtgagcagtgaattccatttcagagtgccttgatgcaggatggaaccatatctatacttgagaaattaggcaacaacccatgatgacaaaaatctttggtggtagaagatgaatagagagtttgtggcgactatatttcacatttgagcatctacaacatactacatcctatgtgtctgaggccatgttgaaataaaatagaataatgcagaatgttaaa

SEQ ID NO: 129074 - DNA, 691 bp, Homo sapiens
  Payload ID: 5246
  Gene Symbol: ENTPD5
  Gene Name: ectonucleoside triphosphate diphosphohydrolase 5
  ENST ID: ENST00000555829
  CDS Start-End: 1-242
tctatgctttctcttactattatgaccgagctgttgacacagacatgattgattatgaaaaggggggtattttaaaagttgaagattttgaaagaaaagccagggaagtgtgtgataacttggaaaacttcacctcaggcagtcctttcctgtgcatggatctcagctacatcacagccctgttaaaggatggctttggctttgcagacagcacagtcttacaggctgccgtactgaggtgatgggccaagctggagatatccccaaagcccatgttgacaccctgtcctgcaagcggatggactctgtgggctgcatccctaagaataaagcagagttcaggtgtgacctctggcagcaaagtgagaagggagtggccctgctctgttatcgtcttacccaatgagcgccacccgaggcctgacgtactcagcagcatgtcccaacccaagaggaaacagaactcggcttttggcatccaccctggctacgcttgggggcagctggcgagccgagaccttagtgggcttcagaaggctgacagcatactgcagcatggcaccagctgtgtcgatgaagtccgtgtggtcagcatcactccactgagcagcatcagccacaagacaaacaaggtgaaatgtgagtagcagggaattaaaaattcaataaagaaaccttgtttgtaaccaaa

SEQ ID NO: 129075 - DNA, 904 bp, Homo sapiens
  Payload ID: 5246
  Gene Symbol: ENTPD5
  Gene Name: ectonucleoside triphosphate diphosphohydrolase 5
  ENST ID: ENST00000553284
  CDS Start-End: 272-904
agagaaaaagagagtaagggaggagggaaggatagagaagggagtgagttagcaaaatgccacactgttagttgcaaactggcacaaaggtgaatgcggttcatgaggctcgcttgattaagaagagctgaaacaggagcaaagagcaaaaggcaacctgcagcgaaagcaaggactcagggaaccggcagacacaagcagcctctgcaggtgtgcgagcaggattgcttctgcaacaaaagcctccacccagccacatcttgggaaaagaatggccacttcttggggcacagtctttttcatgctggtggtatcctgtgtttgcagcgctgtctcccacaggaaccagcagacttggtttgagggtatcttcctgtcttccatgtgccccatcaatgtcagcgccagcaccttgtatggaattatgtttgatgcagggagcactggaactcgaattcatgtttacacctttgtgcagaaaatgccaggacagcttccaattctagaaggggaagtttttgattctgtgaagccaggactttctgcttttgtagatcaacctaagcagggtgctgagaccgttcaagggctcttagaggtggccaaagactcaatcccccgaagtcactggaaaaagaccccagtggtcctaaaggcaacagcaggactacgcttactgccagaacacaaagccaaggctctgctctttgaggtaaaggagatcttcaggaagtcacctttcctggtaccaaagggcagtgttagcatcatggatggatccgacgaaggcatattagcttgggttactgtgaattttctgacaggtcagctgcatggccacagacaggagactgtggggaccttggacctagggggagcctccacccaaatcacgttcctgccc

SEQ ID NO: 129076 - DNA, 3096 bp, Homo sapiens
  Payload ID: 5246
  Gene Symbol: ENTPD5
  Gene Name: ectonucleoside triphosphate diphosphohydrolase 5
  ENST ID: ENST00000557325
  CDS Start-End: 353-1576
ttccttgttcctggtcaacaaagaaatgtggagtgtcttggctgaatcctcatacagacaagatcattatggtgctgttaggtaggacttgtatccagatgtaaggttgaaaaagtgatataataaaggaaccaaggagaaaattcagaaggaaagaaaaaattggtctcactctgtcaccgaggctggagtacagtggtgcaatcacagctcacggcagcttcaaactcctgggctcaagcgatcctcctgcctcaccctcccgagtagctgagactacagcctctgcaggtgtgcgagcaggattgcttctgcaacaaaagcctccacccagccacatcttgggaaaagaatggccacttcttggggcacagtctttttcatgctggtggtatcctgtgtttgcagcgctgtctcccacaggaaccagcagacttggtttgagggtatcttcctgtcttccatgtgccccatcaatgtcagcgccagcaccttgtatggaattatgtttgatgcagggagcactggaactcgaattcatgtttacacctttgtgcagaaaatgccaggacagcttccaattctagaaggggaagtttttgattctgtgaagccaggactttctgcttttgtagatcaacctaagcagggtgctgagaccgttcaagggctcttagaggtggccaaagactcaatcccccgaagtcactggaaaaagaccccagtggtcctaaaggcaacagcaggactacgcttactgccagaacacaaagccaaggctctgctctttgaggtaaaggagatcttcaggaagtcacctttcctggtaccaaagggcagtgttagcatcatggatggatccgacgaaggcatattagcttgggttactgtgaattttctgacaggtcagctgcatggccacagacaggagactgtggggaccttggacctagggggagcctccacccaaatcacgttcctgccccagtttgagaaaactctggaacaaactcctaggggctacctcacttcctttgagatgtttaacagcacttataagctctatacacatagttacctgggatttggattgaaagctgcaagactagcaaccctgggagccctggagacagaagggactgatgggcacactttccggagtgcctgtttaccgagatggttggaagcagagtggatctttgggggtgtgaaataccagtatggtggcaaccaagaaggggaggtgggctttgagccctgctatgccgaagtgctgagggtggtacgaggaaaacttcaccagccagaggaggtccagagaggttccttctatgctttctcttactattatgaccgagctgttgacacagacatgattgattatgaaaaggggggtattttaaaagttgaagattttgaaagaaaagccagggaagtgtgtgataacttggaaaacttcacctcaggcagtcctttcctgtgcatggatctcagctacatcacagccctgttaaaggatggctttggctttgcagacagcacagtcttacagcacatcatcagctgggtaaattgatactcacaaaggcagagttaacggcatccacaaatttttcctcatccatgctaactagctctgctgcatgttcatgggacgtggaccaaaccaaggaactcaaggtgtctgagagctgtgtcaaaagaacaccaataccaacggctaagactctgctgcacttggaaactctcaagcataaaaagacaaaaagggaacttacaaacagcctgggcagattcccttgaaaccagaaaaaggctgagagaaagtgaagaggaaaggcttgcatgcatgtgggcggactggtcagaaggacctcttaccgggagcagagcaataggcccagagggaagaaatctctgccaggctacgttgttttctgtggcctgcaacagagaggagaaaagtttctctgtgaagtacctagtgcctatgaataaagtccccagatggcagctcaggatcttacctctgataaatgcagagtagccacaacagcagactggtcatagttccagctcacattctggattccaacagcctgccgtactccggagttgtgaccatctgcacctatctgcatggacacatgagcctgctaagtcttccagcctcttcataaactgcttcagaagtttttctctgctccctaaagtttcctccagctctgattgttgtgtggcaggataattccatcaggcctgcttcactcacagcccctagaggtggagcccctgcactgtcacatcagcctcagccaacagagccaaagctggacatgactgaacaggtgccagccatgagttaaactcagccaggccctcctgatatttgaactagagagcaataaggaaagtttcagtatggggcacacactggagctgaatagttctgatgtagggttaggaatggctaccatgcaaaaagggaagcttgtgagcagaaaggagaaaaatgagaggcaagagatcaatgaccacagactcctcagagggaaagaacagcctccattcccaacactctggtgcctgtcctgtgaggcccagctatctgttatttcacaacctaagacggcccatgagattgctccctgtacaggatttacgatgagaccatctccacttgagctggcctgaataggtactggtcctcataaccaaaagttttgcctaaaattaaactatagcttaaatcgaaaaccagagtccctagaatctaggataagatgtagatatacaagacccctagcaaaataagaatcttcaactaccaacaatttggtctggaaggtgctgccatcacctagggtaatatgaacccaagggctggagtcggccataggaaatggacaaggccaggtatagcgaatggctttgctcctgtagagaaccgtcactcggtctggggaggtcaaaagagaggaaaaaaaattagaaaggtgggccacataggctgaggaaaaagccataactaaacctaaagcaaggtcccaggacagcagtgtcttgtcatttaagattaaaaaaatcagtaattaa

SEQ ID NO: 129077 - DNA, 2708 bp, Homo sapiens
  Payload ID: 5247
  Gene Symbol: ENTPD6
  Gene Name: ectonucleoside triphosphate diphosphohydrolase 6 (putative)
  Uniprot ID: O75354
  ENST ID: ENST00000354989
  CDS Start-End: 173-1576
gtgacgccacgtgcatggggcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatgcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctccttctctgg

SEQ ID NO: 129078 - DNA, 2766 bp, Homo sapiens
  Payload ID: 5247
  Gene Symbol: ENTPD6
  Gene Name: ectonucleoside triphosphate diphosphohydrolase 6 (putative)
  Uniprot ID: O75354
  ENST ID: ENST00000360031
  CDS Start-End: 183-1634
acgtgcatggggcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctccttctctgg

SEQ ID NO: 129079 - DNA, 2750 bp, Homo sapiens
  Payload ID: 5247
  Gene Symbol: ENTPD6
  Gene Name: ectonucleoside triphosphate diphosphohydrolase 6 (putative)
  Uniprot ID: O75354
  ENST ID: ENST00000376652
  CDS Start-End: 164-1618
caggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctccttctctgg

SEQ ID NO: 129080 - DNA, 2100 bp, Homo sapiens
  Payload ID: 5247
  Gene Symbol: ENTPD6
  Gene Name: ectonucleoside triphosphate diphosphohydrolase 6 (putative)
  ENST ID: ENST00000376666
  CDS Start-End: 1-886
ggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacggtgggagtcacctggagcgtgaagggacgtgtctcatccccagtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctccttctctgg

SEQ ID NO: 129081 - DNA, 940 bp, Homo sapiens
  Payload ID: 5247
  Gene Symbol: ENTPD6
  Gene Name: ectonucleoside triphosphate diphosphohydrolase 6 (putative)
  ENST ID: ENST00000433417
  CDS Start-End: 1-940
ggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatgaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtggg

SEQ ID NO: 129082 - DNA, 656 bp, Homo sapiens
  Payload ID: 5247
  Gene Symbol: ENTPD6
  Gene Name: ectonucleoside triphosphate diphosphohydrolase 6 (putative)
  ENST ID: ENST00000418890
  CDS Start-End: 73-656
caaaagaccggctgccgcctgctccccggaaaagggcactcgtctccgtgggtgtggcggagcgcgcggtgcatgcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgc

SEQ ID NO: 129083 - DNA, 945 bp, Homo sapiens
  Payload ID: 5247
  Gene Symbol: ENTPD6
  Gene Name: ectonucleoside triphosphate diphosphohydrolase 6 (putative)
  ENST ID: ENST00000425813
  CDS Start-End: 45-945
cgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcag

SEQ ID NO: 129084 - DNA, 809 bp, Homo sapiens
  Payload ID: 5247
  Gene Symbol: ENTPD6
  Gene Name: ectonucleoside triphosphate diphosphohydrolase 6 (putative)
  ENST ID: ENST00000417467
  CDS Start-End: 130-809
gtggggtcgtatcccgcgggtggaggccggggtggcgccggccggggcgggggagcccaaaagaccggctgccgcctgctccccggaaaagggcactcgtctccgtgggtgtggcggagcgcgcggtgcatgccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacag

SEQ ID NO: 129085 - DNA, 878 bp, Homo sapiens
  Payload ID: 5247
  Gene Symbol: ENTPD6
  Gene Name: ectonucleoside triphosphate diphosphohydrolase 6 (putative)
  ENST ID: ENST00000435520
  CDS Start-End: 315-878
ccaaaagaccggctgccgcctgctccccggaaaagggcactcgtctccgtgggtgtggcggagcgcgcggtgcatgcccgcttttgcggacccgcccccagtctgcgtcagggacagacccctccgccctggatgagcccggcggggaagcttcgcgtagcagtttctgggaaacagcgtgcatggcaggcatttgcattcatgacccttccgtgtacttgaactgaaaacctgaagaaactggccaacagattaggcagccatcaatccacatcagatggcccctgtatttccaagaggaatgggctatgtgaatgaaaaaaggtatccgttatgaaacttccagaaaaacgagctacatttttcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacct

SEQ ID NO: 129086 - DNA, 451 bp, Homo sapiens
  Payload ID: 5247
  Gene Symbol: ENTPD6
  Gene Name: ectonucleoside triphosphate diphosphohydrolase 6 (putative)
  ENST ID: ENST00000427553
  CDS Start-End: 1-451
ggccggggcgggggagcccaaaagaccggctgccgcctgctccccggaaaagggcactcgtctccgtgggtgtggcggagcgcgcggtgcatgaaactcccacgttaacccacgaaaccttcaaagcactgaagccaggtctttctgcctatgctgatgatgttgaaaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacag

SEQ ID NO: 129087 - DNA, 2654 bp, Homo sapiens
  Payload ID: 5247
  Gene Symbol: ENTPD6
  Gene Name: ectonucleoside triphosphate diphosphohydrolase 6 (putative)
  ENST ID: ENST00000433259
  CDS Start-End: 127-1440
ggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacggtgggagtcacctggagcgtgaagggacgtgtctcatccccagtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctccttctctgg

SEQ ID NO: 129088 - DNA, 932 bp, Homo sapiens
  Payload ID: 5247
  Gene Symbol: ENTPD6
  Gene Name: ectonucleoside triphosphate diphosphohydrolase 6 (putative)
  ENST ID: ENST00000447877
  CDS Start-End: 1-932
caggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaag

SEQ ID NO: 129089 - DNA, 1028 bp, Homo sapiens
  Payload ID: 5247
  Gene Symbol: ENTPD6
  Gene Name: ectonucleoside triphosphate diphosphohydrolase 6 (putative)
  ENST ID: ENST00000439162
  CDS Start-End: 140-1028
ctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatgccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctg

SEQ ID NO: 129090 - DNA, 3550 bp, Homo sapiens
  Payload ID: 5248
  Gene Symbol: ENTPD7
  Gene Name: ectonucleoside triphosphate diphosphohydrolase 7
  Uniprot ID: Q9NQZ7
  ENST ID: ENST00000370489
  CDS Start-End: 179-1993
cttccggctgggcaaggggccgcggggagcagctcgggactgaaccgagaggtgccgaaggaaccggcgggccgcttgatcccgctgcagacgtaggagatgcctgggacaaggaggccaccttctcagggcaaaagaaaaagaaggtgacaggcgttgagaccaccgaagggaacccatggctaggatcagtttttcctacctctgcccagcctcctggtacttcactgtgcccacagtgagtccatttctccgtcagcgggtggcattcctgggactcttcttcatatcctgtctccttttacttatgttaatcatagactttcgacattggagtgcttcattaccacgagataggcaatacgaaaggtatttggctcgagtaggggagcttgaagctactgacactgaagacccaaatctgaattatggacttgttgttgactgtggcagcagtggttcccggatttttgtttatttctggccaagacataatgggaacccccatgacttgctggacatcaaacagatgagagaccgcaacagccaaccagtggttaaaaaaatcaagccaggaatctctgcaatggcagacactccagaacatgccagtgattaccttcgtcctctgctgagctttgctgctgctcatgtgcctgtgaagaagcacaaggagacccctctttacatcctctgcacagcaggcatgaggcttctccctgagaggaagcagttggctatcttggctgacctagtgaaagatttaccactggagtttgacttcctcttttcacagtctcaagcagaagtgatctctgggaagcaggaaggggtttatgcatggattggaatcaactttgttttgggaagattcgaccacgaggatgaatcagatgctgaggctacccaggaattggcagcaggacggagaaggacagtagggatactggatatgggaggagcctctctccaaattgcttatgaagttcctacctcaacctctgtccttcctgcaaagcaggaagaagctgccaagatcctgctggctgagttcaacctgggctgtgatgtgcaacacactgaacacgtgtacagggtttatgtcacaacttttctgggtttcggaggcaactttgcccggcagcgctacgaagaccttgttctgaatgaaactcttaacaaaaacagattgcttggtcagaagacaggtctgagtcccgacaatccatttctggatccctgcctgccagtgggactcacagatgtggtggagaggaacagccaagtcttacatgtccgaggaagaggagactgggtgtcttgtggggcaatgctgagccccctgctggctcgctccaacaccagccaggcctcactcaatggcatatatcaatcgcctattgacttcaacaacagcgagttctacggcttctctgagtttttttattgtacagaggatgtgttgcgcattggtggccgctaccatgggccaacatttgccaaggctgctcaggattactgtggcatggcttggtcggtactaactcagagattcaagaatggcctcttttcatcacatgcagatgagcatcgactcaaatatcagtgttttaaatcggcttggatgtaccaagtcttacatgaaggattccactttccctatgactacccaaacctgcggacagcccagctggtgtatgaccgagaggttcagtggacgctgggagccattctatataaaacacgattcttaccactcagggatcttcggcaggaaggtgtccgacaagcccatggtagctggttccgtctctcctttgtatacaaccactatctcttctttgcctgtatcctggtggtgctactggccatcttcctataccttctgcggctacgccgaattcaccaccgacaaacacgagcctcagctccattggacttgctgtggcttgaagaggtggtgcccatgatgggagtacaggtggggccgtgaggctggaccaggactagagaagcttgagcacccccgagttgctgctcattgaattcctccactttcttatatagcctcagatgctgtgatgtctgaccttgtggatatttgcccttggaatttctactttactttctaccgtaattccttctccgtacccaggtcttctctgagagaagctataatttaatctgtgaggaactaaatgacaggagattggtgctaatacgggggaccaagctttgtccaagtgaagcaggcttcgactccttctgagaggtctggtgtgttcctagaatctcaccttttcttcccttgctaaagcatgaagtttggcatttggcacactggaagcctggttgaaatgaaatttgtagcatctgatacaaagccagagacattctagcaagtgcagcagccccttctttctctgtaacagagatatcatttatgtggagatccacaacctttaacagggatccaagatctttgcagttcaatcgaccacataggaatttccaggcaccaaaatgatataacttccttgcttccttgacaaagaagccatcatgggtgtgatccaagatccctgtcgtagtgttgatgatgttagtacatgattttaaaggttagaaccccttctaaatgaatggtctgtggaagattttagtatcttatctgatgcctggtatgatgaggatagaaaatttttccatttttatgtgcctcacaggctgtttgggcattaattttgctttttgagccttaagtgtgttagtaggatggagaaactgtgatggggactgggaacctggatttgtctgattttaggtcactgttccctgggcctgtttttgtgagcccttacacaggaagatataaagagagttctttcatttcactgctaaaatcagtatgtagtatggggaatgtatttgggttgtttttaaagaaaaggggaacagaatcaggagagtgggcaaaggcaataaaatcaaagttcttattaattatttctgagaaatagaagtttctcaatttatgactcttggaatgtctgaaagggagcaaatttggaatagatcaatctgttaataagccatctggcaactttcagaacctctattaagagactgctgagtcacaaacagcacttccattaatgaagcgagaggaaaagccataataattacatcttcacccactacccttccagagctttgcttctcctccacatttagccattaaattgcatgaggatttctcttcatcagggtccgcatggaatctttcttatattttaccctttcctacatgtagccttgaatgtcctttccacgaatatgctcccacggctgggagcattttcttttcttttcgtcacctttgatttttgggattagattaataggggaaaaagtccctggctttaaagaaaacaaaagtagaattcttcaaaaataaatttcatactgggaacagaaaggaactaaatgcttcataaaacagggaaaaagaaattaagatcatcctagaaataaactaagataaaaataa

SEQ ID NO: 129091 - DNA, 548 bp, Homo sapiens
  Payload ID: 5248
  Gene Symbol: ENTPD7
  Gene Name: ectonucleoside triphosphate diphosphohydrolase 7
  ENST ID: ENST00000472998
  CDS Start-End: 1-211
ttgtggggcaatgctgagccccctgctggctcgctccaacaccagccaggcctcactcaatggcatatatcaatcgcctattgacttcaacaacagcgagttctacggcttctctgagtttttttattgtacagaggatgtgttgcgcattggtggccgctaccatgggccaacatttgccaaggctgctcagctggtagcccacaagtaactttagaaatggaacagctgtgactgtggggaaggtagagagtttgcctccaaattcatgttgcactatttctctgtggttgatccaggattactgtggcatggcttggtcggtactaactcagagattcaagaatggcctcttttcatcacatgcagatgagcatcgactcaaatatcagtgttttaaatcggcttggatgtaccaagtcttacatgaaggattccactttccctatgactacccaaacctgcggacagcccagctggtgtatgaccgagaggttcagtggacgctgggagccattctatataaaacacgattcttaccactcagg

SEQ ID NO: 129092 - DNA, 2111 bp, Homo sapiens
  Payload ID: 5249
  Gene Symbol: ENTPD8
  Gene Name: ectonucleoside triphosphate diphosphohydrolase 8
  Uniprot ID: Q5MY95
  ENST ID: ENST00000344119
  CDS Start-End: 185-1561
ccaggtgcacagcgcatcgcccgaggctgtcaccgccctgccccgcccaccccagctgtcctggacccaggggcagggagaggctggacgccaggtgcgcggacacagaagcgtctaagcacagcttcctccttgccgctccgggaagtgggcagccagcccaggaaccagtaccacctgcaccatggggctgtcccggaaggagcaggtcttcttggccctgctgggggcctcgggggtctcaggcctcacggcactcattctcctcctggtggaggccaccagcgtgctcctgcccacagacatcaagtttgggatcgtgtttgatgcgggctcctcccacacgtccctcttcctgtatcagtggctggcgaacaaggagaatggcacgggtgtggtcagccaggccctggcctgccaggtggaagggcctggaatctcctcctacacttctaatgctgcacaggctggtgagagcctgcagggctgcttggaggaggcgctggtgctgatcccagaggcccagcatcggaaaacacccacgttcctgggggccacggctggcatgaggttgctcagccggaagaacagctctcaggccagggacatctttgcagcagtcacccaggtcctgggccggtctcccgtggacttttggggtgccgagctcctggccgggcaggccgaaggtgcctttggttggatcactgtcaactacggcttggggacgctggtcaagtactccttcactggagaatggatccagcctccggaggagatgctggtgggtgccctggacatgggaggggcctccacccagatcacgttcgtgcctgggggccccatcttggacaagagcacccaggccgattttcgcctctacggctccgactacagcgtctacactcacagctacctgtgctttggacgggaccagatgctgagcaggctcctcgtggggctggtacagagccgcccggctgccctgctccgtcacccgtgctacctcagcggctaccagaccacactggccctgggcccgctgtatgagtcaccctgtgtccacgccacgcccccgctgagcctcccccagaacctcacagttgaagggacaggcaaccctggagcctgcgtctcagccatccgggaacttttcaacttctccagctgccagggccaggaggactgcgcctttgacggggtctaccagcccccgctgcggggccagttctatgtggaggccagctaccctgggcaggaccgctggctgcgggactactgtgcctcaggcctgtacatcctcaccctcctgcacgagggctacgggttcagcgaggagacctggcccagcctcgagttccgaaagcaggcgggcggtgtggacattggctggacactgggctacatgctgaacctgaccgggatgatcccggccgatgcgccggctcagtggcgggcagagagctacggcgtctgggtggccaaagtggtgttcatggtgctggccctggtggcggtggtgggggctgccttggtccagctcttctggttgcaggactagtgggaaggcggaggtgggcccccacagagcccacaggcagctgcgtcccggatgctggaggcttcctgagccctgagcgccgtggggccttgctctgtggctctgcccacggtcaggtgacagccacctccagggcaccgtcagggtggtgctggccacagaggctgcatgacctcccctcccggcgtccctcccccaacctccttccgcaactgggcttccagggccgtaggtgcctttctgcacacaggccgccaggactcgtggtgtctccaggctgtgtgactgcagggccacatgctgcctgcaaacagggcaagaccacggaggcacaggggtcctgctcctgatggggcctcaggaggggcggagaggggtggaagggagggagctgccccacctggacccccgctctccctgctgttgtctgagcagatggatggagtccaggcctgggggcttctgctgggccagcccggcctcccacacccacttggagggtgagactgcagtgggggttgtttttattaaaagcatcatggacacagca

SEQ ID NO: 129093 - DNA, 2222 bp, Homo sapiens
  Payload ID: 5249
  Gene Symbol: ENTPD8
  Gene Name: ectonucleoside triphosphate diphosphohydrolase 8
  Uniprot ID: Q5MY95
  ENST ID: ENST00000371506
  CDS Start-End: 185-1672
ccaggtgcacagcgcatcgcccgaggctgtcaccgccctgccccgcccaccccagctgtcctggacccaggggcagggagaggctggacgccaggtgcgcggacacagaagcgtctaagcacagcttcctccttgccgctccgggaagtgggcagccagcccaggaaccagtaccacctgcaccatggggctgtcccggaaggagcaggtcttcttggccctgctgggggcctcgggggtctcaggcctcacggcactcattctcctcctggtggaggccaccagcgtgctcctgcccacagacatcaagtttgggatcgtgtttgatgcgggctcctcccacacgtccctcttcctgtatcagtggctggcgaacaaggagaatggcacgggtgtggtcagccaggccctggcctgccaggtggaagggcctggaatctcctcctacacttctaatgctgcacaggctggtgagagcctgcagggctgcttggaggaggcgctggtgctgatcccagaggcccagcatcggaaaacacccacgttcctgggggccacggctggcatgaggttgctcagccggaagaacagctctcaggccagggacatctttgcagcagtcacccaggtcctgggccggtctcccgtggacttttggggtgccgagctcctggccgggcaggccgaaggtgcctttggttggatcactgtcaactacggcttggggacgctggtcaagtactccttcactggagaatggatccagcctccggaggagatgctggtgggtgccctggacatgggaggggcctccacccagatcacgttcgtgcctgggggccccatcttggacaagagcacccaggccgattttcgcctctacggctccgactacagcgtctacactcacagctacctgtgctttggacgggaccagatgctgagcaggctcctcgtggggctggtacagagccgcccggctgccctgctccgtcacccgtgctacctcagcggctaccagaccacactggccctgggcccgctgtatgagtcaccctgtgtccacgccacgcccccgctgagcctcccccagaacctcacagttgaagggacaggcaaccctggagcctgcgtctcagccatccgggaacttttcaacttctccagctgccagggccaggaggactgcgcctttgacggggtctaccagcccccgctgcggggccagttctatgccttctccaacttctactacaccttccacttcctgaacctcacctccaggcagcccctgagcacggtcaacgccaccatctgggagttttgccagaggccctggaaactggtggaggccagctaccctgggcaggaccgctggctgcgggactactgtgcctcaggcctgtacatcctcaccctcctgcacgagggctacgggttcagcgaggagacctggcccagcctcgagttccgaaagcaggcgggcggtgtggacattggctggacactgggctacatgctgaacctgaccgggatgatcccggccgatgcgccggctcagtggcgggcagagagctacggcgtctgggtggccaaagtggtgttcatggtgctggccctggtggcggtggtgggggctgccttggtccagctcttctggttgcaggactagtgggaaggcggaggtgggcccccacagagcccacaggcagctgcgtcccggatgctggaggcttcctgagccctgagcgccgtggggccttgctctgtggctctgcccacggtcaggtgacagccacctccagggcaccgtcagggtggtgctggccacagaggctgcatgacctcccctcccggcgtccctcccccaacctccttccgcaactgggcttccagggccgtaggtgcctttctgcacacaggccgccaggactcgtggtgtctccaggctgtgtgactgcagggccacatgctgcctgcaaacagggcaagaccacggaggcacaggggtcctgctcctgatggggcctcaggaggggcggagaggggtggaagggagggagctgccccacctggacccccgctctccctgctgttgtctgagcagatggatggagtccaggcctgggggcttctgctgggccagcccggcctcccacacccacttggagggtgagactgcagtgggggttgtttttattaaaagcatcatggacacagca

SEQ ID NO: 129094 - DNA, 668 bp, Homo sapiens
  Payload ID: 5249
  Gene Symbol: ENTPD8
  Gene Name: ectonucleoside triphosphate diphosphohydrolase 8
  ENST ID: ENST00000493135
  CDS Start-End: 1-668
ctgggggcctcgggggtctcaggcctcacggcactcattctcctcctggtggaggccaccagcgtgctcctgcccacagacatcaagtttgggatcgtgtttgatgcgggctcctcccacacgtccctcttcctgtatcagtggctggcgaacaaggagaatggcacgggtgtggtcagccaggccctggcctgccaggtggaagggcctggaatctcctcctacacttctaatgctgcacaggctggtgagagcctgcagggctgcttggaggaggcgctggtgctgatcccagaggcccagcatcggaaaacacccacgttcctgggggccacggctggcatgaggttgctcagcagtcacccaggtcctgggccggtctcccgtggacttttggggtgccgagctcctggccgggcaggccgaaggtgcctttggttggatcactgtcaactacggcttggggacgctggtcaagtactccttcactggagaatggatccagcctccggaggagatgctggtgggtgccctggacatgggaggggcctccacccagatcacgttcgtgcctgggggccccatcttggacaagagcacccaggccgattttcgcctctacggctccgactacagcgtctacactcacagctacctgtgctttggac

SEQ ID NO: 129095 - DNA, 1749 bp, Homo sapiens
  Payload ID: 5249
  Gene Symbol: ENTPD8
  Gene Name: ectonucleoside triphosphate diphosphohydrolase 8
  Uniprot ID: Q5MY95
  ENST ID: ENST00000472938
  CDS Start-End: 18-1505
ccagtaccacctgcaccatggggctgtcccggaaggagcaggtcttcttggccctgctgggggcctcgggggtctcaggcctcacggcactcattctcctcctggtggaggccaccagcgtgctcctgcccacagacatcaagtttgggatcgtgtttgatgcgggctcctcccacacgtccctcttcctgtatcagtggctggcgaacaaggagaatggcacgggtgtggtcagccaggccctggcctgccaggtggaagggcctggaatctcctcctacacttctaatgctgcacaggctggtgagagcctgcagggctgcttggaggaggcgctggtgctgatcccagaggcccagcatcggaaaacacccacgttcctgggggccacggctggcatgaggttgctcagccggaagaacagctctcaggccagggacatctttgcagcagtcacccaggtcctgggccggtctcccgtggacttttggggtgccgagctcctggccgggcaggccgaaggtgcctttggttggatcactgtcaactacggcttggggacgctggtcaagtactccttcactggagaatggatccagcctccggaggagatgctggtgggtgccctggacatgggaggggcctccacccagatcacgttcgtgcctgggggccccatcttggacaagagcacccaggccgattttcgcctctacggctccgactacagcgtctacactcacagctacctgtgctttggacgggaccagatgctgagcaggctcctcgtggggctggtacagagccgcccggctgccctgctccgtcacccgtgctacctcagcggctaccagaccacactggccctgggcccgctgtatgagtcaccctgtgtccacgccacgcccccgctgagcctcccccagaacctcacagttgaagggacaggcaaccctggagcctgcgtctcagccatccgggaacttttcaacttctccagctgccagggccaggaggactgcgcctttgacggggtctaccagcccccgctgcggggccagttctatgccttctccaacttctactacaccttccacttcctgaacctcacctccaggcagcccctgagcacggtcaacgccaccatctgggagttttgccagaggccctggaaactggtggaggccagctaccctgggcaggaccgctggctgcgggactactgtgcctcaggcctgtacatcctcaccctcctgcacgagggctacgggttcagcgaggagacctggcccagcctcgagttccgaaagcaggcgggcggtgtggacattggctggacactgggctacatgctgaacctgaccgggatgatcccggccgatgcgccggctcagtggcgggcagagagctacggcgtctgggtggccaaagtggtgttcatggtgctggccctggtggcggtggtgggggctgccttggtccagctcttctggttgcaggactagtgggaaggcggaggtgggcccccacagagcccacaggcagctgcgtcccggatgctggaggcttcctgagccctgagcgccgtggggccttgctctgtggctctgcccacggtcaggtgacagccacctccagggcaccgtcagggtggtgctggccacagaggctgcatgacctcccctcccggcgtccctcccccaacctccttccgcaactgggcttccagggccgtaggtgcctttctgc

SEQ ID NO: 129096 - DNA, 7442 bp, Homo sapiens
  Payload ID: 5250
  Gene Symbol: ENPP1
  Gene Name: ectonucleotide pyrophosphatase/phosphodiesterase 1
  Uniprot ID: P22413
  ENST ID: ENST00000360971
  CDS Start-End: 21-2798
ccggagcggccggggccacgatggagcgcgacggctgcgcggggggcgggagccgcggcggcgagggcgggcgcgctccccgggagggcccggcggggaacggccgcgatcggggccgcagccacgctgccgaggcgcccggggacccgcaggcggccgcgtccttgctggcccctatggacgtgggggaggagccgctggagaaggcggcgcgcgcccgcactgccaaggaccccaacacctataaagtactctcgctggtattgtcagtatgtgtgttaacaacaatacttggttgtatatttgggttgaaaccaagctgtgccaaagaagttaaaagttgcaaaggtcgctgtttcgagagaacatttgggaactgtcgctgtgatgctgcctgtgttgagcttggaaactgctgtttagattaccaggagacgtgcatagaaccagaacatatatggacttgcaacaaattcaggtgtggtgagaaaaggttgaccagaagcctctgtgcctgttcagatgactgcaaggacaagggcgactgctgcatcaactacagttctgtgtgtcaaggtgagaaaagttgggtagaagaaccatgtgagagcattaatgagccacagtgcccagcagggtttgaaacgcctcctaccctcttattttctttggatggattcagggcagaatatttacacacttggggtggacttcttcctgttattagcaaactaaaaaaatgtggaacatatactaaaaacatgagaccggtatatccaacaaaaactttccccaatcactacagcattgtcaccggattgtatccagaatctcatggcataatcgacaataaaatgtatgatcccaaaatgaatgcttccttttcacttaaaagtaaagagaaatttaatcctgagtggtacaaaggagaaccaatttgggtcacagctaagtatcaaggcctcaagtctggcacatttttctggccaggatcagatgtggaaattaacggaattttcccagacatctataaaatgtataatggttcagtaccatttgaagaaaggattttagctgttcttcagtggctacagcttcctaaagatgaaagaccacacttttacactctgtatttagaagaaccagattcttcaggtcattcatatggaccagtcagcagtgaagtcatcaaagccttgcagagggttgatggtatggttggtatgctgatggatggtctgaaagagctgaacttgcacagatgcctgaacctcatccttatttcagatcatggcatggaacaaggcagttgtaagaaatacatatatctgaataaatatttgggggatgttaaaaatattaaagttatctatggacctgcagctcgattgagaccctctgatgtcccagataaatactattcatttaactatgaaggcattgcccgaaatctttcttgccgggaaccaaaccagcacttcaaaccttacctgaaacatttcttacctaagcgtttgcactttgctaagagtgatagaattgagcccttgacattctatttggaccctcagtggcaacttgcattgaatccctcagaaaggaaatattgtggaagtggatttcatggctctgacaatgtattttcaaatatgcaagccctctttgttggctatggacctggattcaagcatggcattgaggctgacacctttgaaaacattgaagtctataacttaatgtgtgatttactgaatttgacaccggctcctaataacggaactcatggaagtcttaaccaccttctaaagaatcctgtttatacgccaaagcatcccaaagaagtgcaccccctggtacagtgccccttcacaagaaaccccagagataaccttggctgctcatgtaacccttcgattttgccgattgaggattttcaaacacagttcaatctgactgtggcagaagagaagattattaagcatgaaactttaccctatggaagacctagagttctccagaaggaaaacaccatctgtcttctttcccagcaccagtttatgagtggatacagccaagacatcttaatgcccctttggacatcctataccgtggacagaaatgacagtttctctacggaagacttctccaactgtctgtaccaggactttagaattcctcttagtcctgtccataaatgttcattttataaaaataacaccaaagtgagttacgggttcctctccccaccacaactaaataaaaattcaagtggaatatattctgaagctttgcttactacaaatatagtgccaatgtaccagagttttcaagttatatggcgctactttcatgacaccctactgcgaaagtatgctgaagaaagaaatggtgtcaatgtcgtcagtggtcctgtgtttgactttgattatgatggacgttgtgattccttagagaatctgaggcaaaaaagaagagtcatccgtaaccaagaaattttgattccaactcacttctttattgtgctaacaagctgtaaagatacatctcagacgcctttgcactgtgaaaacctagacaccttagctttcattttgcctcacaggactgataacagcgagagctgtgtgcatgggaagcatgactcctcatgggttgaagaattgttaatgttacacagagcacggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacggagccctcggtgatgcggacatctcagggaaacttgcgtactcagcacagcagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaaccttgatggcattgggcaaacagtagacttatagtagggttggggtagcccatgttatgtgactatctttatgagaattttaaagtggttctggatatcttttaacttggagtttcatttcttttcattgtaatcaaaaaaaaaattaacagaagccaaaatacttctgagaccttgtttcaatctttgctgtatatcccctcaaaatccaagttattaatcttatgtgttttctttttaattttttgattggatttctttagatttaatggttcaaatgagttcaactttgagggacgatctttgaatatacttacctattataaaatcttactttgtatttgtatttaaaaaagaaaaatattcctatcctgctcactggtaattaacataggtttaaaatggcttcaaatgtggccctatagacggttaaaattgtaccttatcttggcaaaacttcagagcaccagtcagtgcatgcaaggtgccattttttattgagatgcttagaatgtttctttctgtgcacaagacttaccctaccagcagcagagccattctctgttgagtggttcattttgaagttccacagattgaagagaacatgccaccaatcacctcacatcttcttggtggacatgataaatgacacaatgaacttgatttctttactaccttgactgtagctttttatccctacctgtgaaccttcaaagactgcattaacttttaggctacataggtccaattgaggtataatatcagtacaccaaagatttttatatgtccttcgtgtgaccattcttcaacggcctaagggccagctgcaaagacttttggaaaatacaatttacaactcaaaattatttaataatttaggaagttgctttttttttttttttttttcagtcctgcagtttcctgaagctctgtatatgatatttttttcagcctgcttctctctgttgttcagattaggtaattttattcttctgtctcgaagctcactgattctttattctgtctaatctgttctgctgttgagcccatttattcctgatttttatattttagttattgtatgttttatttctaaaatttccattcagtttttctttatatcttctatttgctgagaatttctgtctctttgctgagactttctacgttttcatttgtttcaagtgcatttatacttgcttgttgaagaatttttatgatggctgctgtaaaatccttatcagataattccaacatctgtcacctcattgtttgcatctactgatggtcttttttccattcggaaacattttcctgtttcttggtgtgtggaatgattttttattgaaacctggatatttttaggtattatgttatgagactatgggtcttatttaaaccttctgctttagccaactttctcagataccaccacagcaggggaattgggagcactgcttcattattaccaggtgtggctaggagtccaggttccccagtcagcctccctttatactgagtaacagggtcccctcattactactgggcaaggtgagaattcagtttcccattaggtctttattgattcttccctggctggaatgtgcagcggcaccttttggtgcaccctgggaatctccactaatgctatgggacagagtgaccaggaagagcttcattacaccaggtgggaatgaaattcccagtagcctacacagccttctccgacaccactctggagttgtattcttccagcacacaaacatacacaatttaactcaaagcatcttagcagagcttaattaaatggatagatgcctgttccctttgctggataccaagaatacaaaagtcagggagttggggcacctctttacagcttggtgagagtgtaagtctggactccccactcagcatttgctggtatgggtggggccatggtgtttttccatggtgtttggttggagtacagccttttttacccttgcttggctacccttttctggtcctttggcaggagagagcaggactctcttagggcttttttttcccctgcatttattgacatttccaggttgctgactttttcagctccaagttggaaatatatgagctgaaaagaaaatgtagggaactcatcacagtgttgttacttgggccccaatgttcctagcctattttctgtctactattcagagtcttgctgtgttttaatataatatccaggatttttatatgcatttagcagaaggatgtctactctgcctttgtagaagtgtctcactgatttttacatatttttccagcacacaaacatacacaatttaactcaaagcatcttagcagagcttaattaaatggatagatgtctgttccctttgctggacgccaagaatacaaaaaagaacaagtgacaattttctctgtcttagggagaagagacagcagaagtgtaaatgatccctaaagagtgatagatgttatcatgaagccacaggaggggtgccaggctgcacaaaagagacactggatgcttcttggtagtagaggcagtggcttcccagccttggggctaaggcttgtagggtgaattggaacttttcagatgagcaaggcaaagaagggaccttctaacattccttggatggaacatttttgacattttcccatttacagctacttatattttctacaagtgtcactgtgaccaacttatgtacacatactttttcttgcttagttataataatctgttcttaaagaaaatgtcagtctctacattctatgctgactgttaaggaaagagcacccacatctgctcctacttagctttttttctgtggttcttacacagtattcctttttttcttttcttgaaagagactcctcctttcttttcttttcttgaaagagttttaaacagataagatggcaaaagtgactgatctctactcccccagtttgaatggtaaatttgaatggtaaattcccatgaacatatatggaaatgtctttatcctactttctccaataaaggctgttcttagcttttcaaatgcaaagtgaaacctttatttatcttgatttcttttttttttttttttttttttttttttttgagatgctctgtcacccaggctggagtgcagtggcaagatcttggctcactgcaagctccgcctcccaggttcacgccattctcctggctcagcctcccgagtaactgggactacaggcacctgccgtcacgcctggctaattttttgtatttttagtagagaatggagtttcaccgtgttagccaggatggtctcgatctcctgaccttgtgatctgcccgcctcggcctcccaaagtgctgggattacaggctcgagccactgcctccagcctatcctgatttctactgtcatgcctcacatcagtccttttttttttttttgagacagagtctcgctctgtggcccaggctagactgcagtggcatgatctcggctcactgcaacctccacctccggggttctagcaattctcctgcctcagcctcctgagtagctgggattataggcgcatgccacacctggctttttgtattttagtggagatggggtttcactgtgttgctcaggctggtcttgatctcctgagctcagacaatccccccgccttggcctcccaaagtgctaggattataggcgagagctgctgtgtgcttcttaagtgaggtaagtaacttccatagaaaatttccatcagttcattcatgaaagaacaaagaacctggcaaaacttaaaaaaacgtttccaagaatcagataaaagaggacaaaccttagggagaagaaggcagctgctcatttccagcaggggaagtagctgcatagagtacaaggactggtaggcctgttggctgttcctgtttaaggagacaagatgggcatggaacagggaccaccccctcctctgggagaagctgttacccccttcacttttcctcctctgtcattacccacaatcactctccttctttgcgctatggtaggtgtttacccatcataggaatgggcatttgaactttgaaactgaatgtggtgattacacttcatgctgaagcttttcacatgagtgctttcataagcattaagtaaaattttataatgactgcagtccaaggacattttccctggtttttggccagtctaaatattgtaagagagagagaagaaaagtgtacggaatataattgtctctaagctaagaaatgtggatgttcaaataaaacatacgtacagaa

SEQ ID NO: 129097 - DNA, 3107 bp, Homo sapiens
  Payload ID: 5250
  Gene Symbol: ENPP1
  Gene Name: ectonucleotide pyrophosphatase/phosphodiesterase 1
  ENST ID: ENST00000513998
  CDS Start-End: 3-1139
cgatggagcgcgacggctgcgcggggggcgggagccgcggcggcgagggcgggcgcgctccccgggagggcccggcggggaacggccgcgatcggggccgcagccacgctgccgaggcgcccggggacccgcaggcggccgcgtccttgctggcccctatggacgtgggggaggagccgctggagaaggcggcgcgcgcccgcactgccaaggaccccaacacctataaagtactctcgctggtattgtcagtatgtgtgttaacaacaatacttggttgtatatttgggttgaaaccaagctgtgccaaagaagttaaaagttgcaaaggtcgctgtttcgagagaacatttgggaactgtcgctgtgatgctgcctgtgttgagcttggaaactgctgtttagattaccaggagacgtgcatagaaccagaacatatatggacttgcaacaaattcaggtgtggtgagaaaaggttgaccagaagcctctgtgcctgttcagatgactgcaaggacaagggcgactgctgcatcaactacagttctgtgtgtcaaggtgagaaaagttgggtagaagaaccatgtgagagcattaatgagccacagtgcccagcagggtttgaaacgcctcctaccctcttattttctttggatggattcagggcagaatatttacacacttggggtggacttcttcctgttattagcaaactaaaaaaatgtggaacatatactaaaaacatgagaccggtatatccaacaaaaactttccccaatcactacagcattgtcaccggattgtatccagaatctcatggcataatcgacaataaaatgtatgatcccaaaatgaatgcttccttttcacttaaaagtaaagagaaatttaatcctgagtggtacaaaggagaaccaatttgggtcacagctaagtatcaaggcctcaagtctggcacatttttctggccaggatcagatgtggaaattaacggaattttcccagacatctataaaatgtataatggttcagtaccatttgaagaaaggattttagctgttcttcagtggctacagcttcctaaagatgaaagaagaaccagattcttcaggtcattcatatggaccagtcagcagtgaagtcatcaaagccttgcagagggttgatggtatggttggtatgctgatggatggtctgaaagagctgaacttgcacagatgcctgaacctcatccttatttcagatcatggcatggaacaaggcagttgtaagaaatacatatatctgaataaatatttgggggatgttaaaaatattaaagttatctatggacctgcagctcgattgagaccctctgatgtcccagataaatactattcatttaactatgaaggcattgcccgaaatctttcttgccgggaaccaaaccagcacttcaaaccttacctgaaacatttcttacctaagcgtttgcactttgctaagagtgatagaattgagcccttgacattctatttggaccctcagtggcaacttgcattgaatccctcagaaaggaaatattgtggaagtggatttcatggctctgacaatgtattttcaaatatgcaagccctctttgttggctatggacctggattcaagcatggcattgaggctgacacctttgaaaacattgaagtctataacttaatgtgtgatttactgaatttgacaccggctcctaataacggaactcatggaagtcttaaccaccttctaaagaatcctgtttatacgccaaagcatcccaaagaagtgcaccccctggtacagtgccccttcacaagaaaccccagagataaccttggctgctcatgtaacccttcgattttgccgattgaggattttcaaacacagttcaatctgactgtggcagaagagaagattattaagcatgaaactttaccctatggaagacctagagttctccagaaggaaaacaccatctgtcttctttcccagcaccagtttatgagtggatacagccaagacatcttaatgcccctttggacatcctataccgtggacagaaatgacagtttctctacggaagacttctccaactgtctgtaccaggactttagaattcctcttagtcctgtccataaatgttcattttataaaaataacaccaaagtgagttacgggttcctctccccaccacaactaaataaaaattcaagtggaatatattctgaagctttgcttactacaaatatagtgccaatgtaccagagttttcaagttatatggcgctactttcatgacaccctactgcgaaagtatgctgaagaaagaaatggtgtcaatgtcgtcagtggtcctgtgtttgactttgattatgatggacgttgtgattccttagagaatctgaggcaaaaaagaagagtcatccgtaaccaagaaattttgattccaactcacttctttattgtgctaacaagctgtaaagatacatctcagacgcctttgcactgtgaaaacctagacaccttagctttcattttgcctcacaggactgataacagcgagagctgtgtgcatgggaagcatgactcctcatgggttgaagaattgttaatgttacacagagcacggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacggagccctcggtgatgcggacatctcagggaaacttgcgtactcagcacagcagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaacct

SEQ ID NO: 129098 - DNA, 2651 bp, Homo sapiens
  Payload ID: 5251
  Gene Symbol: ENPP2
  Gene Name: ectonucleotide pyrophosphatase/phosphodiesterase 2
  Uniprot ID: Q13822
  ENST ID: ENST00000075322
  CDS Start-End: 60-2651
agtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggctcaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaa

SEQ ID NO: 129099 - DNA, 3233 bp, Homo sapiens
  Payload ID: 5251
  Gene Symbol: ENPP2
  Gene Name: ectonucleotide pyrophosphatase/phosphodiesterase 2
  Uniprot ID: Q13822
  ENST ID: ENST00000259486
  CDS Start-End: 51-2798
cgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgaggagagtagttatggctcaccttttactccggctaagagacctaagaggaaagttgcccctaagaggagacaggaaagaccagttgctcctccaaagaaaagaagaagaaaaatacataggatggatcattatgctgcggaaactcgtcaggacaaaatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggctcaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 129100 - DNA, 3271 bp, Homo sapiens
  Payload ID: 5251
  Gene Symbol: ENPP2
  Gene Name: ectonucleotide pyrophosphatase/phosphodiesterase 2
  ENST ID: ENST00000427067
  CDS Start-End: 182-2836
gtcccccgggacagcggccccctgactacatctgcactggagaaatcccaaaagcaaacggccagtgcaaacaagagcagtccgcagcagccgtcccgagcacagctcccaggtcgcggggctgcagcccaggccgcgtccgcagcgcccgggcaggaacagacgccgagactcccgcagcatgacccgccacgccgatcggataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggctcaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagctgaaaccaggaaattcagaggcagcagaaatgaaaacaaggaaaacattaatggaaattttgaacctagaaaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 129101 - DNA, 2667 bp, Homo sapiens
  Payload ID: 5251
  Gene Symbol: ENPP2
  Gene Name: ectonucleotide pyrophosphatase/phosphodiesterase 2
  Uniprot ID: Q13822
  ENST ID: ENST00000522826
  CDS Start-End: 1-2667
atggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggctcaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagctgaaaccaggaaattcagaggcagcagaaatgaaaacaaggaaaacattaatggaaattttgaacctagaaaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaa

SEQ ID NO: 129102 - DNA, 769 bp, Homo sapiens
  Payload ID: 5251
  Gene Symbol: ENPP2
  Gene Name: ectonucleotide pyrophosphatase/phosphodiesterase 2
  ENST ID: ENST00000520066
  CDS Start-End: 35-769
acacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccggtaagttttgca

SEQ ID NO: 129103 - DNA, 991 bp, Homo sapiens
  Payload ID: 5251
  Gene Symbol: ENPP2
  Gene Name: ectonucleotide pyrophosphatase/phosphodiesterase 2
  ENST ID: ENST00000518958
  CDS Start-End: 45-533
ggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcaggaggcccataagaacaaaagcatctcctggggagaggatacactcatggagtatttggagaatcccaagaagcacatccccggaacaaaaatgatcttcgcaggcatgaagaacaaggcagaaagggcagccttgatagctcatctcaaaaaaagctaccaatgaataataacaggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtca

SEQ ID NO: 129104 - DNA, 1695 bp, Homo sapiens
  Payload ID: 5251
  Gene Symbol: ENPP2
  Gene Name: ectonucleotide pyrophosphatase/phosphodiesterase 2
  ENST ID: ENST00000522167
  CDS Start-End: 87-1583
agcattggaatttggggcttctcccttctagtggagttcggaggatgaaaattggctgactctttggcagttctgttaagaatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggctcaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgt

SEQ ID NO: 129105 - DNA, 3162 bp, Homo sapiens
  Payload ID: 5252
  Gene Symbol: ENPP3
  Gene Name: ectonucleotide pyrophosphatase/phosphodiesterase 3
  Uniprot ID: O14638
  ENST ID: ENST00000357639
  CDS Start-End: 84-2711
atacagtttctctttgccagactagactaaagaaggagcactaatttattctgataaaacaggtctatgcagctaccaggacaatggaatctacgttgactttagcaacggaacaacctgttaagaagaacactcttaagaaatataaaatagcttgcattgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaggaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccaatgtggctgacagcaatgtatcaaggtttaaaagccgctacctacttttggcccggatcagaagtggctataaatggctcctttccttccatatacatgccttacaacggaagtgtcccatttgaagagaggatttctacactgttaaaatggctggacctgcccaaagctgaaagacccaggttttataccatgtattttgaagaacctgattcctctggacatgcaggtggaccagtcagtgccagagtaattaaagccttacaggtagtagatcatgcttttgggatgttgatggaaggcctgaagcagcggaatttgcacaactgtgtcaatatcatccttctggctgaccatggaatggaccagacttattgtaacaagatggaatacatgactgattattttcccagaataaacttcttctacatgtacgaagggcctgccccccgcatccgagctcataatatacctcatgacttttttagttttaattctgaggaaattgttagaaacctcagttgccgaaaacctgatcagcatttcaagccctatttgactcctgatttgccaaagcgactgcactatgccaagaacgtcagaatcgacaaagttcatctctttgtggatcaacagtggctggctgttaggagtaaatcaaatacaaattgtggaggaggcaaccatggttataacaatgagtttaggagcatggaggctatctttctggcacatggacccagttttaaagagaagactgaagttgaaccatttgaaaatattgaagtctataacctaatgtgtgatcttctacgcattcaaccagcaccaaacaatggaacccatggtagtttaaaccatcttctgaaggtgcctttttatgagccatcccatgcagaggaggtgtcaaagttttctgtttgtggctttgctaatccattgcccacagagtctcttgactgtttctgccctcacctacaaaatagtactcagctggaacaagtgaatcagatgctaaatctcacccaagaagaaataacagcaacagtgaaagtaaatttgccatttgggaggcctagggtactgcagaagaacgtggaccactgtctcctttaccacagggaatatgtcagtggatttggaaaagctatgaggatgcccatgtggagttcatacacagtcccccagttgggagacacatcgcctctgcctcccactgtcccagactgtctgcgggctgatgtcagggttcctccttctgagagccaaaaatgttccttctatttagcagacaagaatatcacccacggcttcctctatcctcctgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgatttttttctggagaattgtaaaataaagttttctatttttccttaagtcccctaaaagccataatttttattattcctttttctcttttttcaattctatgaatatgtattattttaaagttatatttttcacacagagatgatgctatattacaccttcccttttttgttggtttcttaaactctaatctcatgacagattataccttccttattacttgttttatcttactcagaatctttgaatatatttttctgcccagaattatctaaacaaaagggagaacaaaagaagtatgtctcacttgggaactgaatcaactctaaatcagttttgtcacaaaactttttgtatttgactggcaatgctgattaaaattaaaaatgc

SEQ ID NO: 129106 - DNA, 3026 bp, Homo sapiens
  Payload ID: 5252
  Gene Symbol: ENPP3
  Gene Name: ectonucleotide pyrophosphatase/phosphodiesterase 3
  ENST ID: ENST00000358229
  CDS Start-End: 84-2075
atacagtttctctttgccagactagactaaagaaggagcactaatttattctgataaaacaggtctatgcagctaccaggacaatggaatctacgttgactttagcaacggaacaacctgttaagaagaacactcttaagaaatataaaatagcttgcattgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaggaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccaatgtggctgacagcaatgtatcaaggtttaaaagccgctacctacttttggcccggatcagaagtggctataaatggctcctttccttccatatacatgccttacaacggaagtgtcccatttgaagagaggatttctacactgttaaaatggctggacctgcccaaagctgaaagacccaggttttataccatgtattttgaagaacctgattcctctggacatgcaggtggaccagtcagtgccagagtaattaaagccttacaggtagtagatcatgcttttgggatgttgatggaaggcctgaagcagcggaatttgcacaactgtgtcaatatcatccttctggctgaccatggaatggaccagacttattgtaacaagatggaatacatgactgattattttcccagaataaacttcttctacatgtacgaagggcctgccccccgcatccgagctcataatatacctcatgacttttttagttttaattctgaggaaattgttagaaacctcagttgccgaaaacctgatcagcatttcaagccctatttgactcctgatttgccaaagcgactgcactatgccaagaacgtcagaatcgacaaagttcatctctttgtggatcaacagtggctggctgttaggagtaaatcaaatacaaattgtggaggaggcaaccatggttataacaatgagtttaggagcatggaggctatctttctggcacatggacccagttttaaagagaagactgaagttgaaccatttgaaaatattgaagtctataacctaatgtgtgatcttctacgcattcaaccagcaccaaacaatggaacccatggtagtttaaaccatcttctgaaggtgcctttttatgagccatcccatgcagaggaggtgtcaaagttttctgtttgtggctttgctaatccattgcccacagagtctcttgactgtttctgccctcacctacaaaatagtactcagctggaacaagtgaatcagatgctaaatctcacccaagaagaaataacagcaacagtgaaagtaaatttgccatttgggaggcctagggtactgcagaagaacgtggaccactgtctcctttaccacagggaatatgtcagtggatttggaaaagctatgaggatgcccatgtggagttcatacacagtcccccagttgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgatttttttctggagaattgtaaaataaagttttctatttttccttaagtcccctaaaagccataatttttattattcctttttctcttttttcaattctatgaatatgtattattttaaagttatatttttcacacagagatgatgctatattacaccttcccttttttgttggtttcttaaactctaatctcatgacagattataccttccttattacttgttttatcttactcagaatctttgaatatatttttctgcccagaattatctaaacaaaagggagaacaaaagaagtatgtctcacttgggaactgaatcaactctaaatcagttttgtcacaaaactttttgtatttgactggcaatgctgattaaaattaaaaatgc

SEQ ID NO: 129107 - DNA, 3418 bp, Homo sapiens
  Payload ID: 5252
  Gene Symbol: ENPP3
  Gene Name: ectonucleotide pyrophosphatase/phosphodiesterase 3
  Uniprot ID: O14638
  ENST ID: ENST00000414305
  CDS Start-End: 329-2956
gagaaatgaaaagtttggaacccagaagctgcagcctgcggaaaatgctggagccgcagccgacaccaagttgatgtctgtgagcagctgaccttctggacctccatcagcggcctgcagccaggagctgaagccacagagacggtgtcttctcagctatgataacctcagtgcaaatattgcccaatcactgaagagctgtgatcttcctaaacagttaaaagtcaggcacagctatgtaactcatacagtttctctttgccagactagactaaagaaggagcactaatttattctgataaaacaggtctatgcagctaccaggacaatggaatctacgttgactttagcaacggaacaacctgttaagaagaacactcttaagaaatataaaatagcttgcattgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaggaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccaatgtggctgacagcaatgtatcaaggtttaaaagccgctacctacttttggcccggatcagaagtggctataaatggctcctttccttccatatacatgccttacaacggaagtgtcccatttgaagagaggatttctacactgttaaaatggctggacctgcccaaagctgaaagacccaggttttataccatgtattttgaagaacctgattcctctggacatgcaggtggaccagtcagtgccagagtaattaaagccttacaggtagtagatcatgcttttgggatgttgatggaaggcctgaagcagcggaatttgcacaactgtgtcaatatcatccttctggctgaccatggaatggaccagacttattgtaacaagatggaatacatgactgattattttcccagaataaacttcttctacatgtacgaagggcctgccccccgcatccgagctcataatatacctcatgacttttttagttttaattctgaggaaattgttagaaacctcagttgccgaaaacctgatcagcatttcaagccctatttgactcctgatttgccaaagcgactgcactatgccaagaacgtcagaatcgacaaagttcatctctttgtggatcaacagtggctggctgttaggagtaaatcaaatacaaattgtggaggaggcaaccatggttataacaatgagtttaggagcatggaggctatctttctggcacatggacccagttttaaagagaagactgaagttgaaccatttgaaaatattgaagtctataacctaatgtgtgatcttctacgcattcaaccagcaccaaacaatggaacccatggtagtttaaaccatcttctgaaggtgcctttttatgagccatcccatgcagaggaggtgtcaaagttttctgtttgtggctttgctaatccattgcccacagagtctcttgactgtttctgccctcacctacaaaatagtactcagctggaacaagtgaatcagatgctaaatctcacccaagaagaaataacagcaacagtgaaagtaaatttgccatttgggaggcctagggtactgcagaagaacgtggaccactgtctcctttaccacagggaatatgtcagtggatttggaaaagctatgaggatgcccatgtggagttcatacacagtcccccagttgggagacacatcgcctctgcctcccactgtcccagactgtctgcgggctgatgtcagggttcctccttctgagagccaaaaatgttccttctatttagcagacaagaatatcacccacggcttcctctatcctcctgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgatttttttctggagaattgtaaaataaagttttctatttttccttaagtcccctaaaagccataatttttattattcctttttctcttttttcaattctatgaatatgtattattttaaagttatatttttcacacagagatgatgctatattacaccttcccttttttgttggtttcttaaactctaatctcatgacagattataccttccttattacttgttttatcttactcagaatctttgaatatatttttctgcccagaattatctaaacaaaagggagaacaaaagaagtatgtctcacttgggaactgaatcaactctaaatcagttttgtcacaaaactttttgtatttgactggcaatgctgattaaaattaaaaatgcacagaactttt

SEQ ID NO: 129108 - DNA, 598 bp, Homo sapiens
  Payload ID: 5252
  Gene Symbol: ENPP3
  Gene Name: ectonucleotide pyrophosphatase/phosphodiesterase 3
  ENST ID: ENST00000423831
  CDS Start-End: 82-243
acagtttctctttgccagactagactaaagaaggagcactaatttattctgataaaacaggtctatgcagctaccaggacaatggaatctacgttgactttagcaacggaacaacctgttaagaagaacactcttaagaaatataaaatagcttgcattacagggtctctctcctttgggatctcacctcaccacaacctctgtttcccaggctcaagtgatcctcctgcctcagcctcctgagtagcttggaccacaggcacatgccacaaggctcagctaagtttttgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaggaaagattgctgtgctgactat

SEQ ID NO: 129109 - DNA, 1536 bp, Homo sapiens
  Payload ID: 5252
  Gene Symbol: ENPP3
  Gene Name: ectonucleotide pyrophosphatase/phosphodiesterase 3
  ENST ID: ENST00000427707
  CDS Start-End: 348-509
gctaacccgcttgcagactgagaaatgaaaagtttggaacccagaagctgcagcctgcggaaaatgctggagccgcagccgacaccaagttgatgtctgtgagcagctgaccttctggacctccatcagcggcctgcagccaggagctgaagccacagagacggtgtcttctcagctatgataacctcagtgcaaatattgcccaatcactgaagagctgtgatcttcctaaacagttaaaagtcaggcacagctatgtaactcatacagtttctctttgccagactagactaaagaaggagcactaatttattctgataaaacaggtctatgcagctaccaggacaatggaatctacgttgactttagcaacggaacaacctgttaagaagaacactcttaagaaatataaaatagcttgcattggtctctctcctttgggatctcacctcaccacaacctctgtttcccaggctcaagtgatcctcctgcctcagcctcctgagtagcttggaccacaggcacatgccacaaggctcagctaagtttttgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaggaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccagtatgtagcattctacacgtcgcaactgaagtaacctccatttctcagtgtgacaggaggacactcttctcactcagtggagcaagttctatgtcacccatctagtttctaagggctgagggtgcaaagatgtggctgacagcaatgtatcaaggtttaaaagccgctacctacttttggcccggatcagaagtggctataaatggctcctttccttccatatacatgccttacaacggaagtgtcccatttgaagagaggatttctacactgttaaaatggctggacctgcccaaagctg

SEQ ID NO: 129110 - DNA, 4651 bp, Homo sapiens
  Payload ID: 5253
  Gene Symbol: ENPP4
  Gene Name: ectonucleotide pyrophosphatase/phosphodiesterase 4 (putative)
  Uniprot ID: Q9Y6X5
  ENST ID: ENST00000321037
  CDS Start-End: 231-1592
ggagcgccccgagcggcgcagatagggacgttggggctgtgccccgcggcgcggcgcctgccactgcgcaggcgcctcaggaagagctcggcatcgcccctcttcctccaggtcccccttccccgcaacttcccacgagtgccaggtgccgcgagcgccgagttccgcgcattggaaagaagcgaccgcggcggctggaaccctgattgctgtccttcaacgtgttcattatgaagttattagtaatacttttgttttctggacttataactggttttagaagtgactcttcctctagtttgccacctaagttactactagtatcctttgatggcttcagagctgattatctgaagaactatgaatttcctcatctccagaattttatcaaagaaggtgttttggtagagcatgttaaaaatgtttttatcacaaaaacatttccaaaccactacagtattgtgacaggcttgtatgaagaaagccatggcattgtggctaattccatgtatgatgcagtcacaaagaaacacttttctgactctaatgacaaggatcctttttggtggaatgaggcagtacctatttgggtgaccaatcagcttcaggaaaacagatcaagtgctgctgctatgtggcctggtactgatgtacccattcacgataccatctcttcctattttatgaattacaactcctcagtgtcatttgaggaaagactaaataatattactatgtggctaaacaattcgaacccaccagtcacctttgcaacactatattgggaagaaccagatgcaagtggccacaaatacggacctgaagataaagaaaacatgagcagagtgttgaaaaaaatagatgatcttatcggtgacttagtccaaagactcaagatgttagggctatgggaaaatcttaatgtgatcattacaagtgatcatgggatgacccagtgttctcaggacagactgataaacctggattcctgcatcgatcattcatactacactcttatagatttgagcccagttgctgcaatacttcccaaaataaatagaacagaggtttataacaaactgaaaaactgtagccctcatatgaatgtttatctcaaagaagacattcctaacagattttattaccaacataatgatcgaattcagcccattattttggttgccgatgaaggctggacaattgtgctaaatgaatcatcacaaaaattaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatactaagtgcttgttagttgaccagtggtgcattaatctcccagaagccatcgcgattgttatcggttcactcttggtgttaaccatgctaacatgcctcataataatcatgcagaatagactttctgtacctcgtccattttctcgacttcagctacaagaagatgatgatgatcctttaattgggtgacatgtgctagggcttatacaaagtgtctttgattaatcacaaaactaagaatacatccaaagaatagtgttgtaactatgaaaaagaatactttgaaagacaaagaacttagactaagcatgttaaaattattactttgttttccttgtgttttgtttcggtgcatttgctaataagataacgctgaccatagtaaaattgttagtaaatcattaggtaacatcttgtggtaggaaatcattaggtaacatcaatcctaactagaaatactaaaaatggcttttgagaaaaatacttcctctgcttgtattttgcgatgaagatgtgatacatctttaaatgaaaatataccaaaatttagtaggcatgtttttctaataaatttatatatttgtaaagaaaacaacagaaatctttatgcaatttgtgaattttgtatattagggaggaaaagcttcctatatttttatatttacctttaattagtttgtatctcaagtaccctcttgaggtaggaaatgctctgtgatggtaaataaaattggagcagacagaaaagatatagcaaatgaagaaatattttaaggaaacctatttgaaaaaaaaagcaaagaccatttgataaaagcctgagttgtcaccattatgtcttaagctgttagtcttaaagattattgttaaaaaattcagaagaaaagagagacaagtgctcttctctctatctatgcttaatgcctttatgtaagttacttagttgtttgcgtgtgcctgtgcaagtgtgtttgtgtgtggttgtgtggacattatgtgatttactatataaggaggtcagagatggactgtggccaggcttccacattcctgaagcacacagatctcaggaaaggttatttttgcacttcatatttgtttactttctcctaactcacaagttaaaatcataacttaatttcattaacttttatcatttaactctctcatgtttgttgtaacctgaggtatccaaatgctacagaaaaatttatgacccaaatacaaatctcaatttgactgggacagaatgaggaatggagatttttgtatttatctttgggactttatgccttactttttaggctatagaatagttaagaaattttaaacaaaatttagtatcttttggtctttcacaccattcatatgttaagtggcagaatagccttagtgctacctccacttttttctccagtatttgcatcacagaaataatccctctgtttaacatgtttgttcagagccaagggtttattgtgaagaactgtcatcctgcctttgctagctggtaccttctagtaatcaaaattaatatgaagaaactaggttgtgacagactagattatatttagtaggggaaaaattgggctcaagaaccattcatcagtacgtgagacaagcagttaatagtatgatctttaaagttttgacaatataaaataaacttggtaactgttttacaaatataaaagtataataaatatgcagcccagttaaatattgattatctgtgatggtaaagaacaacagtggtgccagtcatcaaacatacagtgcgtcctattgagtcactgctaatttcttgagcctggtatttgctgcctattgtatttgtggttgttgagaggcattttcaaaccctgtataaataatccatgctgttggtcataagttaactgtattaagaacagtaaaataaataaaaaccaatagtactaattttgctttaaaaaaatttctaatttttttcacataaaacaattatcctaaaggttaatagttgatcgaaacagaataatagaaaaattctactttaatttccattaaaaagcaaatagcattgacacatttaaagcttttcatttaaagtagtggatgtttttgaagtatctaaaatagtagcagaatattttatacttggtccttgcaatggtgtgagttttaatgattgcattatcgtgattggtggttatgagtttcagaaatctatacttggcatccaactcatgagtggattttatataggatggaacaggaaggtatgtcctgtcagtatcttaaccctttcaacaagacatttacctatttgtctttccttacgttctcaaaatattaactcgaattgtaaattaagcaaaaatttaaaaagtatatgttgatgggacaagaagaatagtatttatttaataaaacatatattatattgaactatgtgttaattcatttgtatcttttaaaaaattatcactgttaaagccattgactcctttagtacactgagaaaaatcttatagtaaaactagcctttcacattaaggttttggtgtgtattttgttaaataactaacatgctgctctattttctgggtgtagaaagtatttggctctaggaaacatttacttgtttgtgaaaacaataccccaaggtaataggaaaagtttgagttaagtgtttttaattcagtcagtgaattcagaataagtacattcatgtataacatagggacagttctgctgctgttatttatatgcaattcttctggtaaatagcaatagaataaaacatatttcaatgtttgtgtataggttttatattattattccactaggaatggcataagaatttatagataaattcttgtaacattaaaggattaaaatgtttttacattgtttttgggtgtctccttcttgtgcccatatctgataagctttatggattattgcatttaattccttttatttggagggttttacttccttgttaacatataaagttataaatgaaggacaaggaggagatggaaaatgtgtatttattgttaattcttaaaatagtgtgtaaataaaataacatcagtgtgctttaaagaaatgtgtatgtagtgccttaatttaaattaaaatatttttgactgttacttgagttcagaattaatgactttgttcatgatttttaaaatgtgtgtgaataaaatctaccaaaaaattcttactgtaattattaaatataaagttcagtgtca

SEQ ID NO: 129111 - DNA, 2544 bp, Homo sapiens
  Payload ID: 5254
  Gene Symbol: ENPP5
  Gene Name: ectonucleotide pyrophosphatase/phosphodiesterase 5 (putative)
  Uniprot ID: Q9UJA9
  ENST ID: ENST00000230565
  CDS Start-End: 200-1633
aggtgctccgctccagagttgagcgcaggtgagctcctgcgcgttccgggggcgttcctccagtcaccctcccgccgttacccgcggcgcgcccgagggagtctcctccagaccctccctcccgttgctccaaactaatacggactgaacggatcgctgcgaggattatcttacactgaactgatcaagtactttgaaaatgacttcgaaatttctcttggtgtccttcatacttgctgcactgagtctttcaaccaccttttctctccaaccagaccagcaaaaggttctactagtttcttttgatggattccgttgggattacttatataaagttccaacgccccattttcattatattatgaaatatggtgttcacgtgaagcaagttactaatgtttttattacaaaaacctaccctaaccattatactttggtaactggcctctttgcagagaatcatgggattgttgcaaatgatatgtttgatcctattcggaacaaatctttctccttggatcacatgaatatttatgattccaagttttgggaagaagcgacaccaatatggatcacaaaccagagggcaggacatactagtggtgcagccatgtggcccggaacagatgtaaaaatacataagcgctttcctactcattacatgccttacaatgagtcagtttcatttgaagatagagttgccaaaattattgaatggtttacgtcaaaagagcccataaatcttggtcttctctattgggaagaccctgatgacatgggccaccatttgggacctgacagtccgctcatggggcctgtcatttcagatattgacaagaagttaggatatctcatacaaatgctgaaaaaggcaaagttgtggaacactctgaacctaatcatcacaagtgatcatggaatgacgcagtgctctgaggaaaggttaatagaacttgaccagtacctggataaagaccactataccctgattgatcaatctccagtagcagccatcttgccaaaagaaggtaaatttgatgaagtctatgaagcactaactcacgctcatcctaatcttactgtttacaaaaaagaagacgttccagaaaggtggcattacaaatacaacagtcgaattcaaccaatcatagcagtggctgatgaagggtggcacattttacagaataagtcagatgactttctgttaggcaaccacggttacgataatgcgttagcagatatgcatccaatatttttagcccatggtcctgccttcagaaagaatttctcaaaagaagccatgaactccacagatttgtacccactactatgccacctcctcaatatcaccgccatgccacacaatggatcattctggaatgtccaggatctgctcaattcagcaatgccaagggtggtcccttatacacagagtactatactcctccctggtagtgttaaaccagcagaatatgaccaagaggggtcatacccttatttcataggggtctctcttggcagcattatagtgattgtattttttgtaattttcattaagcatttaattcacagtcaaatacctgccttacaagatatgcatgctgaaatagctcaaccattattacaagcctaatgttactttgaagtggatttgcatattgaagtggagattccataattatgtcagtgtttaaaggtttcaaattctgggaaaccagttccaaacatttgcagaaaccattaagcagttacatatttaggtatacacacacacacacacacacatacacacacacggaccaaaatacttacacctgcaaaggaataaagatgtgagagtatgtctccattgttcactgtagcatagggatagataagatcctgctttatttggacttggcgcagataatgtatatatttagcaactttgcactatgtaaagtaccttatgtattgcactttaaatttctctcctgatgggtactttaatttgaaatgcactttatgcacagttatgtcttataacttgattgaaaatgacaactttttgcacccatgtcacagaatacttgttacgcattgttcaaactgaaggaaatttctaataatcccgaataatgaacgtagaaatctatctccataaattgagagaagaagaaggtgataagtgttgaaaattaaatgtgataacctttgaaccttgaattttggagatgtattcccaacagcagaatgcaactgtgggcatttcttgtcttatttctttccagagaacgtggttttcatttatttttccctcaaaagagagtcaaatactgacagattcgttctaaatatattgtttctgtcataaaattattgtgatttcctgatgagtcatattactgtgattttcataataatgaagacaccatgaatatactttttttctatatagttcagcaatggcctgaatagaagcaaccaggcaccatctcagcaatgttttctcttgtttgtaattatttgctcctttgaaaattaaatcactattaattacattaa

SEQ ID NO: 129112 - DNA, 3834 bp, Homo sapiens
  Payload ID: 5254
  Gene Symbol: ENPP5
  Gene Name: ectonucleotide pyrophosphatase/phosphodiesterase 5 (putative)
  Uniprot ID: Q9UJA9
  ENST ID: ENST00000371383
  CDS Start-End: 262-1695
aggtgctccgctccagagttgagcgcaggtgagctcctgcgcgttccgggggcgttcctccagtcaccctcccgccgttacccgcggcgcgcccgagggagtctcctccagaccctccctcccgttgctccaaactaatacggactgaacggatcgctgcgagggtgggagagaaaattagggggagaaaggacagagagagcaactaccatccatagccagatagattatcttacactgaactgatcaagtactttgaaaatgacttcgaaatttctcttggtgtccttcatacttgctgcactgagtctttcaaccaccttttctctccaaccagaccagcaaaaggttctactagtttcttttgatggattccgttgggattacttatataaagttccaacgccccattttcattatattatgaaatatggtgttcacgtgaagcaagttactaatgtttttattacaaaaacctaccctaaccattatactttggtaactggcctctttgcagagaatcatgggattgttgcaaatgatatgtttgatcctattcggaacaaatctttctccttggatcacatgaatatttatgattccaagttttgggaagaagcgacaccaatatggatcacaaaccagagggcaggacatactagtggtgcagccatgtggcccggaacagatgtaaaaatacataagcgctttcctactcattacatgccttacaatgagtcagtttcatttgaagatagagttgccaaaattattgaatggtttacgtcaaaagagcccataaatcttggtcttctctattgggaagaccctgatgacatgggccaccatttgggacctgacagtccgctcatggggcctgtcatttcagatattgacaagaagttaggatatctcatacaaatgctgaaaaaggcaaagttgtggaacactctgaacctaatcatcacaagtgatcatggaatgacgcagtgctctgaggaaaggttaatagaacttgaccagtacctggataaagaccactataccctgattgatcaatctccagtagcagccatcttgccaaaagaaggtaaatttgatgaagtctatgaagcactaactcacgctcatcctaatcttactgtttacaaaaaagaagacgttccagaaaggtggcattacaaatacaacagtcgaattcaaccaatcatagcagtggctgatgaagggtggcacattttacagaataagtcagatgactttctgttaggcaaccacggttacgataatgcgttagcagatatgcatccaatatttttagcccatggtcctgccttcagaaagaatttctcaaaagaagccatgaactccacagatttgtacccactactatgccacctcctcaatatcaccgccatgccacacaatggatcattctggaatgtccaggatctgctcaattcagcaatgccaagggtggtcccttatacacagagtactatactcctccctggtagtgttaaaccagcagaatatgaccaagaggggtcatacccttatttcataggggtctctcttggcagcattatagtgattgtattttttgtaattttcattaagcatttaattcacagtcaaatacctgccttacaagatatgcatgctgaaatagctcaaccattattacaagcctaatgttactttgaagtggatttgcatattgaagtggagattccataattatgtcagtgtttaaaggtttcaaattctgggaaaccagttccaaacatttgcagaaaccattaagcagttacatatttaggtatacacacacacacacacacacatacacacacacggaccaaaatacttacacctgcaaaggaataaagatgtgagagtatgtctccattgttcactgtagcatagggatagataagatcctgctttatttggacttggcgcagataatgtatatatttagcaactttgcactatgtaaagtaccttatgtattgcactttaaatttctctcctgatgggtactttaatttgaaatgcactttatgcacagttatgtcttataacttgattgaaaatgacaactttttgcacccatgtcacagaatacttgttacgcattgttcaaactgaaggaaatttctaataatcccgaataatgaacgtagaaatctatctccataaattgagagaagaagaaggtgataagtgttgaaaattaaatgtgataacctttgaaccttgaattttggagatgtattcccaacagcagaatgcaactgtgggcatttcttgtcttatttctttccagagaacgtggttttcatttatttttccctcaaaagagagtcaaatactgacagattcgttctaaatatattgtttctgtcataaaattattgtgatttcctgatgagtcatattactgtgattttcataataatgaagacaccatgaatatactttttttctatatagttcagcaatggcctgaatagaagcaaccaggcaccatctcagcaatgttttctcttgtttgtaattatttgctcctttgaaaattaaatcactattaattacattaaaaatcaaattggataaaacaatgttttctttctggtagcgcataataacagagcacaagcatcttttagatttgagcatttgaagattcaaagttgcgaaagagcacaaaccatattaggtaaaatattggccactcgatccttgaaaagaactgtgtggagcctggaaaaaaaaattaggaccacatgtgagatgtttacaagacacccagaacagtggtaaagtgtgcatactagaaaaagcagcaaaataactctttgtggtaacaggtatcaaaacacgggagccgagatgatatagctctgtttcaagaaatatgtgaatacccacctaccaggtgctcagtggaatcaaagatgaatccaagttcacaaatagacttctacttccaaggtagtacttttgacctgcctggtcatctcagtcttttccattccaacaacctaaggctgtgctttagatttctaagtaatcaagaagtttgggagaggcatagtattacatgtggcttcttagaggaaagaggaagccctgaaaagaaagactttccttgaagaaaatagcattttacagacacatggatagtactgtgatttcatgtatatatatgtaccaattggctaatgagtaggtaaaattgtattactattccagaaagaaaggacaaatgggatgtgaagaactaaagtgacatagttaaaaatttaaccaaatttaagtgcttcctaaaatttggtgaatgtcttattttttaaaatgataataccaataaggaatgttggcacataattcccatttcattataaaacctcttaatagaatagaatcaaataattggaaatggcctatagattaaaaagctgagaaagtatatggtaggtagcaaactccccagaagtatgaactctggattagacatctcagaatacatgagcactcatgttggcttgctttgtagctatgaacttaccctgtattattgaaatgtcagcataatgactggaaggtgaaattggtccattttagagcattactattatgctatctgtccatttaaattaataattgcattaaattcattttagaaggtgctattacattagtagtaagaaagtaaattcatatataaatatttgattatcagatggtttacttacagatacttattttcctgtaaaataggagagtttacctgaagaaaaataaaacttttaacttttctgggaa

SEQ ID NO: 129113 - DNA, 3936 bp, Homo sapiens
  Payload ID: 5255
  Gene Symbol: ENPP6
  Gene Name: ectonucleotide pyrophosphatase/phosphodiesterase 6
  Uniprot ID: Q6UWR7
  ENST ID: ENST00000296741
  CDS Start-End: 143-1465
aaattctgcaagtgaacttgactcaggaaggccagcggctcaaggtccagcccctggaagagagaatagctacagattctccatcctcagtctttgcaaggcgacagctgtgccagccgggctctggcaggctcctggcagcatggcagtgaagcttgggaccctcctgctggcccttgccctgggcctggcccagccagcctctgcccgccggaagctgctggtgtttctgctggatggttttcgctcagactacatcagtgatgaggcgctggagtcattgcctggtttcaaagagattgtgagcaggggagtaaaagtggattacttgactccagacttccctagtctctcgtatcccaattattataccctaatgactggccgccattgtgaagtccatcagatgatcgggaactacatgtgggaccccaccaccaacaagtcctttgacattggcgtcaacaaagacagcctaatgcctctctggtggaatggatcagaacctctgtgggtcactctgaccaaggccaaaaggaaggtctacatgtactactggccaggctgtgaggttgagattctgggtgtcagacccacctactgcctagaatataaaaatgtcccaacggatatcaattttgccaatgcagtcagcgatgctcttgactccttcaagagtggccgggccgacctggcagccatataccatgagcgcattgacgtggaaggccaccactacgggcctgcatctccgcagaggaaagatgccctcaaggctgtagacactgtcctgaagtacatgaccaagtggatccaggagcggggcctgcaggaccgcctgaacgtcattattttctcggatcacggaatgaccgacattttctggatggacaaagtgattgagctgaataagtacatcagcctgaatgacctgcagcaagtgaaggaccgcgggcctgttgtgagcctttggccggcccctgggaaacactctgagatatataacaaactgagcacagtggaacacatgactgtctacgagaaagaagccatcccaagcaggttctattacaagaaaggaaagtttgtctctcctttgactttagtggctgatgaaggctggttcataactgagaatcgagagatgcttccgttttggatgaacagcaccggcaggcgggaaggttggcagcgtggatggcacggctacgacaacgagctcatggacatgcggggcatcttcctggccttcggacctgatttcaaatccaacttcagagctgctcctatcaggtcggtggacgtctacaatgtcatgtgcaatgtggtgggcatcaccccgctgcccaacaacggatcctggtccagggtgatgtgcatgctgaagggccgcgccagcactgccccgcctgtctggcccagccactgtgccctggcactgattcttctcttcctgcttgcataactgatcatattgcttgtctcagaaaaaaacaccatcagcaaagtgggcctccaaagccagatgattttcattttatgtgtgaataatagcttcattaacacaatcaagaccatgcacattgtaaatacattattcttggataattctatacataaaagttcctacttgttaaaaaagatacaaaccttgtttttccagaaggtaggaaaatcctagctttccatttgtgcagttatatgtcattttctcctttcttttcacgttactcaggatgaactctctgagcagggacctgctcctgcagcaaccaaacttggagtggttattgcagacagacgtggctctgggcccctctctgtcccaccttgcacaaaggaccccctcagaccaggcccttgtctgtgccctgtccacacccaggagccatcctcagtgtctgtggccacaatcctgtactgttccttccatccctgataaaaggaggtctacatgaaagcaaaagctactgtctatttctgacccagctcatggaattttttcatcttatactgagctccagaaaggacgtaacttagcatggatcaccaatcaatcaaaaaataaataaatcactaaggattggagaactcatagaacaaggtgaaagacatgagtgccctcccaaagtctgagtgcacgaaaatttctctcttgccttgaggagcagaaaagcttctgatggacatgggcttctgtgagacttatcacacatagtgtatcgtggcatgaagcccggcacatagcaggccctgcatattgatggacaaatggatggcctgcctgccttccctgtccgttcacctgtgcaaaggcttcctcagacatgccactctgtggctcccaatatagggtgcagacaagagcaatccctgacatgacattatagcctgggaaagggctggctcactgatgagaatgtggaggcatcagcaaggatctcggtgggttgctcagagaggtgatgcactaagccttaatcctggacaccagtacccctgcagcatggcttgctcaacaacagtctttgagtggcatagaattccaaagaaaatggtgctgggtggagaatggagagagcatgatggagcagagtcccagtcactgaccaactaactggtcgtttgattaggaaacagtttggccaaagtaccacctttgagacctaagttcttttgatacctttgagaagagccactgagcctgagttgaaatatttttagcttagtcatctgtgtttgctataggagaaattgtaacacaagaaataactcctttttacatgatcatttatatctatatacatatatatacttgcatacactatcactgcattaaaaaatgagtttgggctgggcatggtggctcacacctataatcccaacactttcggaggccaaggagggacaaacgaacccttgaggccaggagttccagactaacttgggcaacacagggcgacccccatctctacaaaacataaaagatttttaaaaaattagccaggcatggtggcacatgcctgtggtctcagctacttgggaggctgaggcaggagaatcatttgagcccaggaggtcaaggctgcagtgagctttgatcacaccactgcactccagcctgggcaacagagcaagaccccatcctccaccccccccaaaaaatagaaagaaaaaaaaagtttgcactaattgaggtacatctgcaagtgagactttttgtcaggaaaaggcaatatatcaggtctcctcaggacgatggaggccttatatggtgtgttaccttgaaaactgaatatcaacgttcaccttgattcaggaaagctgggtgctgtctccatgccatgaatcatgagagcaaaggatcactgcttaaaaatactgaatttaccttcacaaaagatttctaaagatttatgtaatgtgttttaaaagcgccagtaaaccatcggatcaattggaaagaaggcaactcttcagcctttgttatctagctgaaaacaaatgacaactttcaaaacattggcagtagttgttgaaaaagacgtctattgttcaaagtttctttctccttaaaggacggtgttccaatgaattcagtagagcccactttcctccactgtggaggaagaatccctaagagatactcaaatgattaaattaaaattggatcatcaaactcaagagaggcataaacttagacacagtcttgcatttttgtctttcctgaactcttctgccattttcctccttcactcgtcctgaaaatctgcaagttacataataaaactttagatatttgtctgacaaagtgtaattactcaactgaataaatgactgagaacaagttacaaaaggaatcatgaatcctggtaaacaataaagaagattcagacactgagggaaaaaaataaagctttttacttaaataatgca

SEQ ID NO: 129114 - DNA, 852 bp, Homo sapiens
  Payload ID: 5255
  Gene Symbol: ENPP6
  Gene Name: ectonucleotide pyrophosphatase/phosphodiesterase 6
  ENST ID: ENST00000512353
  CDS Start-End: 269-852
ctaggttagacggttcaagacctggagactggctttgagcaaccctaggattaccttggcttgaattccatccaatacgtctctttcttcatatattggagaggagattaggacccagacgggcacagagggaagaccacatatagacacagggggaaggcggctgcctgcagaccaaggagagaggcctcagaagaaatcaaccctgatgacatcttgatctcaaactcccagcctccagaactgccgccattgtgaagtccatcagatgatcgggaactacatgtgggaccccaccaccaacaagtcctttgacattggcgtcaacaaagacagcctaatgcctctctggtggaatggatcagaacctctgtgggtcactctgaccaaggccaaaaggaaggtctacatgtactactggccaggctgtgaggttgagattctgggtgtcagacccacctactgcctagaatataaaaatgtcccaacggatatcaattttgccaatgcagtcagcgatgctcttgactccttcaagagtggccgggccgacctggcagccatataccatgagcgcattgacgtggaaggccaccactacgggcctgcatctccgcagaggaaagatgccctcaaggctgtagacactgtcctgaagtacatgaccaagtggatccaggagcggggcctgcaggaccgcctgaacgtcattattttctcggatcacggaatgaccgacattttctggatggacaaagtgattgagctgaataagtacatcagcctgaatgacctgcagcaagtgaaggaccgcgggcctgttgtgagcctttggccggcccctgggaaaca

SEQ ID NO: 129115 - DNA, 2043 bp, Homo sapiens
  Payload ID: 5256
  Gene Symbol: ENPP7
  Gene Name: ectonucleotide pyrophosphatase/phosphodiesterase 7
  Uniprot ID: Q6UWV6
  ENST ID: ENST00000328313
  CDS Start-End: 222-1598
agatgctcaagttgatgccaccccacgcacgtgaggctgggaccaggggtggcactgacacggctggggagcccactcccgaggttcgacccggggatgtgcacagccacattccaaaggcgcacgggatgagatcagcccgggtgaccctgggactttgtcctcctcggcaggagccagccctgtgcaccctgtgtgcctgtccatctggaaggcccagcatgagaggcccggccgtcctcctcactgtggctctggccacgctcctggctcccggggccggagcaccggtacaaagtcagggctcccagaacaagctgctcctggtgtccttcgacggcttccgctggaactacgaccaggacgtggacacccccaacctggacgccatggcccgagacggggtgaaggcacgctacatgacccccgcctttgtcaccatgaccagcccctgccacttcaccctggtcaccggcaaatatatcgagaaccacggggtggttcacaacatgtactacaacaccaccagcaaggtgaagctgccctaccacgccacgctgggcatccagaggtggtgggacaacggcagcgtgcccatctggatcacagcccagaggcagggcctgagggctggctccttcttctacccgggcgggaacgtcacctaccaaggggtggctgtgacgcggagccggaaagaaggcatcgcacacaactacaaaaatgagacggagtggagagcgaacatcgacacagtgatggcgtggttcacagaggaggacctggatctggtcacactctacttcggggagccggactccacgggccacaggtacggccccgagtccccggagaggagggagatggtgcggcaggtggaccggaccgtgggctacctccgggagagcatcgcgcgcaaccacctcacagaccgcctcaacctgatcatcacatccgaccacggcatgacgaccgtggacaaacgggctggcgacctggttgaattccacaagttccccaacttcaccttccgggacatcgagtttgagctcctggactacggaccaaacgggatgctgctccctaaagaagggaggctggagaaggtgtacgatgccctcaaggacgcccaccccaagctccacgtctacaagaaggaggcgttccccgaggccttccactacgccaacaaccccagggtcacacccctgctgatgtacagcgaccttggctacgtcatccatgggagaattaacgtccagttcaacaatggggagcacggctttgacaacaaggacatggacatgaagaccatcttccgcgctgtgggccctagcttcagggcgggcctggaggtggagccctttgagagcgtccacgtgtacgagctcatgtgccggctgctgggcatcgtgcccgaggccaacgatgggcacctagctactctgctgcccatgctgcacacagaatctgctcttccgcctgatggaaggcctactctcctgcccaagggaagatctgctctcccgcccagcagcaggcccctcctcgtgatgggactgctggggaccgtgattcttctgtctgaggtcgcataacgccccatggctcaaggaagccgccgggagctgcccgcaggccctgggccggctgtctcgctgcgatgctctgctggtcgcggacggaccctgcctccccagcttatcccaggccagaggctgcatgccactgtccccggcagcgccaacccctgcttggctgttatggtgctggtaataagcctcgcagcccaggtccagagcccccggcgagccggtcccataaccggccccctgcccctgcccctgctcctgctcctccccttcgggccccctcctcctgcaaaacccgctcccgaagcggcgctgccgtctgcagccacgcgggggcgcgcgggagctctgcgggcgctggaacctgcagacccggcctcggtcagctgggaggggcccgccccggcacaaagcacccatgggaataaaggccaagccgcgacagtcagca

SEQ ID NO: 129116 - DNA, 2002 bp, Homo sapiens
  Payload ID: 5256
  Gene Symbol: ENPP7
  Gene Name: ectonucleotide pyrophosphatase/phosphodiesterase 7
  ENST ID: ENST00000576512
  CDS Start-End: 1-480
ctcaaggacgcccaccccaagctccacgtctacaagaaggaggcgttccccgaggccttccactacgccaacaaccccagggtcacacccctgctgatgtacagcgaccttggctacgtcatccatgggagaattaacgtccagttcaacaatggggagcacggctttgacaacaaggacatggacatgaagaccatcttccgcgctgtgggccctagcttcagggcgggcctggaggtggagccctttgagagcgtccacgtgtacgagctcatgtgccggctgctgggcatcgtgcccgaggccaacgatgggcacctagctactctgctgcccatgctgcacacagaatctgctcttccgcctgatggaaggcctactctcctgcccaagggaagatctgctctcccgcccagcagcaggcccctcctcgtgatgggactgctggggaccgtgattcttctgtctgaggtcgcataacgccccatggctcaaggtcagagacccagaaggcagaggcgggagggtggccccacgctccctgaccctccaccctgatgtcccagctacagtcctaggcaaccagaacagagctgccaggccccgccaagcaggtgactcccactgacctggctgccccagagaggccatcacccctgagatcccgaggctgacccttccagcctctctgctctgggcttggaggaggtctttccagagcagaccacccggaccagtggccagaattcccaccctcccccaaaagccagaactccctcagcctctggccagagctgctgcctcccctccttcctgccatctctgtgctccactgggatagctcggaaaccgtcacctgcggtgcatttgggaggagagctctggggctgtgttcctggaactctccaggagcctcctaggacacgcatgaggtgtgtttggtaggagagcaccagggctatattcctggaactctctggaagcccacctctgaggacacgcgtggggtgcatttaggaggagagctctggggctgcgttcctggaactctctggaagcccacctccaaggacacgcgtggggtgcatttgggaggagagctccggggctgcgttcctggaactctctggaagcccacctccaaggacacgcatggggtgcgtttgggaggagagctccggggctgtgttcctggaactccccgggagcctccgaggacagtgctcccttgtctgtctgtgcagccacagcctcctaggccaagcagaagaaagtcattcattcatcccgaaaatatgtaacgggagccagctccatgccacgctctggtctgggctcaggatatgcagcgaacaagacagtccaggacctgtcatttaaaggtgcaagaaagcagagaacacaaaagcaaatgaatccacgcacagagtgctcagatgcttgtgatggcaaagaagagacggccacaggcagggacgaggcaggcgcgaccttgtcatttgcccggcctggaatggcctctctgagaaggtggatttagggagaaaaccagaatgacagacacaccagaagaagccagacacaccaggcaggggaaagagccagggacaggcccgcggtgggacaggttcggcgtgtttgggatgagacagaaggccagtgtgcctgcaggttggcacagagcgaggctctaacaggagctgaccacagccccaaggcaggaggttgtgggatgcacagcggggagccccaagctgaggttacacagggtctgaggttgatgattaaatgagtggctcccactgctgggccggggacagaaacgggagcaggaagtggccagtttggaggtggctgcaggacccagccggacattccagtggcggggtggagaagctgcaatgtgcacagattccaaatacctttaagaggcacgacattcgaggtttgtggacagattatgtgggagggtgaagaaaatgcaaaaatgaaagatgggtcc

SEQ ID NO: 129117 - DNA, 12633 bp, Homo sapiens
  Payload ID: 5257
  Gene Symbol: EPG5
  Gene Name: ectopic P-granules autophagy protein 5 homolog (C. elegans)
  Uniprot ID: Q9HCE0
  ENST ID: ENST00000282041
  CDS Start-End: 36-7775
caaaaacaaacggtgacggcgccgcggaagggtctatggccgaggcggtgaagccccagcgccgggccaaggccaaggccagccggactaaaacaaaggaaaagaagaagtatgaaactcctcagagggaagagtccagtgaagtctcccttccaaaaacctccagagagcaggaaatcccttctctagcctgtgaattcaaaggagaccatctgaaggtggtaactgattcccagctccaggatgatgccagtggacaaaatgagagtgaaatgtttgatgtaccactcacctccttaactataagcaatgaagagtccctgacgtgtaacacagagcccccaaaggaagggggagaggccagaccctgtgtgggggacagtgcagtcactccaaaggtccaccctggagacaatgttggaactaaagtagaaacccccaagaacttcacagaggtagaggaaaatatgtcggtacaaggtggactttcagaaagtgcaccccaatctaatttttcttatactcagccagcaatggaaaatatacaagtcagagaaactcagaatagtaaagaagacaaacaaggcctggtttgttcttcagaggtgccacagaatgttggcttgcagagttcttgcccagccaaacatggttttcagacacctagagtgaagaaactgtatccccagttgccagctgaaattgctggagaagcaccagctttggtggcagtgaaacccttgcttcgcagtgagcgactctacccagaactcccgtctcaactggaactagtaccatttactaaagaacagctaaaaatcttggagcctggttcatggctggaaaatgttgagtcatatttagaagaatttgacagcatggctcatcaagacaggcatgaattttatgagttgcttttgaactactcacgatgtaggaagcaactgctgctggctgaagctgagctgcttactctgacatctgattgccaaaatgctaaaagtcggctgtggcagtttaaggaggaacaaatgtctgtacagggtatctgtgcagatcaagtgaaagttttcagctatcatcgctaccaaagagtagaaatgaatgaaaatgcactggtggagctaaagaagctattcgatgccaaatctgagcacctccaccagaccctggcccttcattcttatacttctgtgctctcaagattgcaagtggagtcttacatctatgcattgctcagtagttcagctgttctgagatcttcagcaattcaccagcaaggccgagcgtctaagcagacagaaagcattccctctgatctgtgtcaactaaaggaatgcattagtgtcttattcatgttcaccaggagagttaatgaagatactcagtttcatgatgatattcttctctggctgcagaaattggtatccgtgctacaaagagttggctgtcctggagatcacctcttccttctaaaccatattcttcgatgccccgctggtgttagtaaatgggctgttccttttatccagatcaaagtgttgcataacccatcaggggtctttcattttatgcaatcccttgccctgctgatgtctcctgtcaaaaatcgagctgagtttatgtgccacatgaagcccagcgagcggaagccatcctcctcagggcctgggtctgggacttggacgctagtagacgaaggaggagaagaggatgaagaccctgagaccagttggattctccttaatgaagatgatttggttaccattttagcacagttcccctttcatgaactctttcagcatcttcttgggtttaaagcaaaaggtgattatttacctgaaacaacaagacctcaagagatgatgaaaatttttgcctttgccaactcactagtggaacttctggctgtggggttagaaacctttaatagagcacgctataggcagtttgtgaagcgaattggttatatgatcaggatgactcttggttatgtaagtgaccattgggcacagtatgtgagccataaccaaggctcaggattggcccaacagccctactctatggagaaactacaggttgaatttgatgaactgtttttgagggctgtcctacatgtgctgaaggccaaaagacttggcatttggctgtttatgtccgagatgccctttgggactctgtctgtgcaaatgctgtggaagctcttctacctcatgcaccaggtggagagcgagaacctgcagcagctctcctcctccctgcagcccgcccagtgcaagcagcagctccaagacccagaacattttaccaactttgagaagtgtctttcttctatgaatagctcagaagagatttgccttctgactacctttgctcagatggctcaggccagaagaaccaatgtggacgaagacttcataaaaattattgttctggagatatatgaggtatcttatgtcaccttgtctaccagagagactttttcaaaggttggtcgagagcttttagggactatcacagctgttcaccctgagataatttccgtccttctggatagagttcaagagaccattgaccaggttggaatggtttctctatacttgtttaaagaactgcctttgtatctttggcaaccttctgcatctgagatagcggtgattcgggattggttattgaattacaacctgacagtggtgaagaataaactggcctgtgttattcttgaaggactgaattggggatttgctaaacaggctacccttcatctggatcaagcagtccatgctgaagtggctttaatggttcttgaagcttatcagaagtaccttgcacagaagccatatgctgggattctctctgaaagtatgaagcaggtttcatatttggccagtattgttcgatatggagagacacccgagacctcatttaaccaatgggcctggaatttaatcttgaggctaaaactgcacaaaaacgattatggaatacagccgaattgtccagctgttcccttctccgtcactgtgcctgacatgacagagtcacccacgtttcatcctctcttgaaggctgtgaaagcgggcatgcccattggctgttatctagccttatctatgacagctgtgggccacagcattgagaagttctgtgcagaaggcatcccactattgggaattctggtccagtcaagacatttgagaacagtggttcatgtcctggataagattctgcctttattttacccttgccagtattaccttctgaagaatgagcagtttttatcgcatctcctcttgttcctacacttggacagcggtgtccctcagggtgtcacacaacaggtcacccacaaggtggcacagcacctgacaggagccagccatggggacaacgtgaagcttctcaacagcatgatccaggcacacatatctgtaagcactcagcccaatgaagtgggccccgttgctgtgttggagttctgggttcaggctctcataagccagcatctctggtaccgagaacaacctatcctcttcctcatggaccacttgtgtaaagcagcttttcagctgatgcaggaagactgcatacagaaattactctaccaacaacataagaatgccttgggttaccactgtgaccggagtctgctctcatctttggtaagctggattgtggcaggcaacatcactccttcctttgtggagggcttggccacgcccactcaggtctggtttgcctggacagtgctcaacatggaatccatctttgaagaggactcccagctccggagagttattgaaggggaattggtgataaactctgctttcacccctgaccaagctctgaagaaagcccagacccagctgaagctccccatcgtgccatccctccagaggctgctgatttatcgctgggcccaccaggctctggtcacaccttctgatcaccccctcctgccactcatttggcagaagttcttccttctgtatcttcaccgtccgggaccacagtatgggttacccatagatggttgtattggaagaaggttttttcaaagtcctgctcatatcaatttgttgaaagaaatgaagagacgtttgaccgaggtggctgacttccaccatgctgcaagcaaggccctccgtgttccagcagagggcagtgaagggctgccagagagccactctggcacccctggttacctgacttcaccagaactgcacaaggagctggtgaggctcttcaatgtatatatattatggctagaagatgagaattttcaaaaaggagatacctatatcccttctctaccaaagcattatgatattcacaggctagcaaaagtgatgcagaatcagcaggatctgtggatggagtatttgaacatggagcgcatctatcatgagtttcaggagactgttggtctgtggacacaggccaagcttgagtcccattccacaccctgcagtttgtccgtgcagctggacttcactgatcctttgctggctaaagaaagggttttaagtaacttgcggaagcatgaggctccccagcctccccttgctctgcacccgacgaagcctcctgtgccagttatttcctctgctgtgctattgagtcagaaggacgccacccagctggtgtgcacagacctgaatctgttgcaacagcaggccagaaccgcagctcttcgggaatctcagcaggttgctctggatggtgagctgttagacacaatgccaaagcagtatgtgaatcgtgaagaacagaccacactacatttggagtgcagaggcagcagcggtaagaaatgccaaggagccgcagttgtcacggttcagtttgaaggcatgcataagaatgaagccataagccaacagcttcatgttttacggaaggaagtgaagcagttgcaagcagaagctgctaaaccaccatcacttaatattgtggaagctgctgtacatgcagaaaacttgatcacggccttagtgaatgcctacaagttgcagcctacacctgggattcagaaagttggcattagccttttctttactattgtggattacgtcagcgatgagacgcagcgtcatcccccaacaaggcagttctttacttcatgtattgagatcttgggacaggtatttatcagtggcattaaatcagagtgcagaaaagtacttgaaaccattctgaagaacagcaggctctgctccctgctgtctcctttcttcactcccaatgctgcacctgcagagttcatacagctgtatgagcaagtggtgaagtttctaagtgaggacaacagtgatatgattttcatgctgctaaccaagttcgatcttaaacaatggttaagcgccactaaacctcctctgtctgatcgtaccaggcttctggagtccattcacttggcacttactgcctggggccttgaaccagatgaggatattttgatgccatttaatcttttctgtaagcactggacttatcttcttctctaccagtttcctgaccagtacagtgacattctcaggctgcttatgcaaagctccgcggagcagcttctgagccccgagtgttggaaggccactctgagagccctgggctgctgcgcccccagctgccagcagggggcagcgtccaccgagggcgccgtgcttcccagctcttctgatgctctcttgtcagacaagcaggtaatggagactatacagtggctttcagactttttttataagcttcggttatccaagatggactttaaaagctttggtttattctcaaaatggagtccttatatggctgatgtgaagacattcttgggctaccttgtgaaaaggctgattgacttagaaatgacctgtttggcccaagacccaactgccagcaggaaaacagtgctgaaatccctacattcagtaatcattcagctctttaagccatggatcctggttttagaggacaacgaaagcagccaacagcggcattacccctggctagagagtgatactgtggtggcctcaagcattgtgcagctgttcactgactgtattgactcactgcatgagagttttaaagataagctgttgccaggtgatgcaggagccctttggttgcacctgatgcattattgtgaagcatgtacagcacccaaaatgccagagttcattctgtacgctttccatagcacgtaccggaaactgccatggaaggacctgcaccctgaccagatgctcatggaggccttcttcaaagtggaacgaggaagccccaagagctgtttcttatttttggggtctgtactctgtgaagtcaactgggttagtgtgctctctgatgcctggaattccagtccccacccagaaacccgcagcatgattgtctgcctccttttcatgatgattttattggcaaaggaagttcaactggtagaccaaacagattcacctttacttagtctccttggacagacaagctcactttcatggcatcttgtggatattgtgtcgtaccagagtgtgctaagttatttcagcagccattacccgccgtccatcatcctggcaaaagaatcttatgctgaattaatcatgaagctcctaaaagtgtctgcgggcctttctattcctactgacagccagaagcatcttgatgcagttccaaaatgccaagcttttactcatcagatggttcaattcctcagcaccctggaacaaaatggaaaaatcaccttagcagtcctagaacaggaaatgtctaagctcttagacgatatcattgtctttaacccgcccgacatggacagccagacccgccacatggccctcagcagcctctttatggaagtcctgatgatgatgaacaacgcgactattccaacagcagagttccttcggggcagtatccggacctggattggccaaaaaatgcatgggctggtggtgctgccccttttaacagcagcctgccagagcctggcgtccgtccgccacatggctgagactacagaagcctgcatcactgcctacttcaaagaaagccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaagctccgtggaggaagaggcaaagctgtttttgtggtggcaccaagtccttcagctctccctcattcagacagagcagaatgactccgtcctgacagaatctgtcattcgaattctgctcttggttcagagcaggcagaacctcgtggctgaggagagactcagctctgggatcctgggggcaattgggtttggccggaagtcgcctttgtctaacaggttccgagtggttgcccgaagcatggctgccttcctttcagttcaggttcctatggaagatcagatccgtttgaggcctggctctgaattacatctgacccccaaagctcagcaggctctgaatgctcttgaatccatggcatcaagtaagcagtatgttgaataccaggatcaaatattgcaagccacccaatttataaggcatcctggccattgccttcaagatgggaaaagcttcttggctcttctcgttaactgtctgtatccagaagtgcattatttggaccacatacgatagttaacactgaggctcttgaaaaacccattgctgtttatgtttacatttaactttgctgttgcacaagtaactttgctcaattgcactgtagagctcagtttggccaatgtgtagttgactgagatgcaagttgggaggcgttagatattagataattttggggtgtgtgtgtgtgtgtgtgtgtgttttcttagctcttaagaccttctggggactctttaagtttttatatttatccacaagagaaacttactaagttccacttgggtgcagagccactcacagttgccgaatgtcccagtcatctcacaagacctccagatggagttctttgtatgtttccacttctgtctctgttttatgtaaatgttccagatctgacaaccttggaagtcactcagtacccttacttttaaaccccatttgtgttcctccaaagtaaagaagtcaattttgaaaaatttctgcatttctcaaatgtggacaaatacaatagttttaaagtattgtttttctcagaagggagataaaaatgccgagttagttaaagtgggtcatgtgtaaaatacgaccacttgatcgtgattatagtgggcagtagagatgatgacaagtcaatttccatccagccgtgtatcctcatggagaagctgcctgtctgaatcaggatggcaagctggcagtctgggaggagcatgttttgcacagatgttttgtttggtccacttggtgaggagtgcagacagggctgcctctctctagtcgggagagtctgtgcattccctcgggccctgaccctagcctcattcacatcacttgcccctgtcgacacctaagtttgcaccctttgatagacaccatgttcgatatctgaaaggctcagtgtcaggagacagagactgagggagactgaagacctgattctctgttccctgcttgttttttaacttcaaactcagatgaagccaatggacctgctgaaacacttgtctgtggaaactgggtcaggtcgggagatctactgaaatttggctttttttccatagccacgtgccttctgttgttgacagttcattcattaccaaagcctgtgtgtaactttgccttgttctgtggccatcttcttgctcatgttatttctcctgggaatgagcagtttgacttctgttcccacgttcctcattctatcagctctagatggattttgcctgcatagctggcttaatatgtctttgtgtatgggtagtctgtagcctgagaatatttacctaaaaatgtctaaacagccaccaagaatgtttataggggtataggaatatagttaacagagtgctaatctctcctcaaatgtccttttggaatgcttcccccaaaattgggaagttggtaggagcttttctttactttgaatttctttacttggacagaacgattctgccttaaagacacgctttgcagctctgataaagaacatccctgtttagtctcttgagttttacaggccacaaaatgtccgtctcagagggatctgtctcagcttttcttatttttgcttctctccgttttcaaaattaatcatcttgttctctgtataagaaaatttgagaagctgtggacaatttaatagtctgatctggcaacagcgatttttgtttggaaatattttgtgttttctttgaggaggatataattactgatatcctaggatgtgaaatttttgagtgacagtatgcacattttaaagaaaattatgattaatctgtataatgttttttggtctgtaaaaattataaaaaataaaatcatttatctttggttgtaactgtttaaaaaccaaattatagggatatcacactatcttgtaaagtgtttcagctgttaaagttgctgtaggtttttatgcctgatgtcatttaatttatttgacattgaacttcattaataatcagagatggtcagtgaaagcgcttcctctttaactctttcttgcttaaccttggaaggttgactcaactcctaggtgtctatgggaaactctgggctaggaacgtgctataaagacactgagctagttcagacatggccatgctgctgtagcctcctgggaaagaagggcggcagagagaccagcccgcctgttggcttgcaggggtaatgagccttggcttgaaaaaattgttggcctccagagagcacggggctgtggtttcagaatcagtgatgggtgccgcacatcaagacgggaatcaagcaagaccaaggccctgtggactgagcagcgtggagggcgaacggctgcaggctccagacttcaccacagggtggccaacagtggcatcgggaccaaataaagatgtctaacagcttcctgggagcaggaggaggcaggattctggttgccatgaaaaacatctctctccctctccatcactccccatgctgcagtgcacaggtgggttgcagaggcaggctgcatcccggaatcatgttgtcccactgcctattaatagaacaagtgaagggcagaatgctggaacacaccagacatagagggagggaggtcctgccagatgtgtctacacaactgtctacatagcatgacagtagcagtggattcgggacccacctgtacatgtttccaaagctccttcctgcacactcgggacctcagctccaaggcgtgactcatttctcagtctcaccatcctttgttggctcagacatcgcatgcctctgccccactggggttgtgtgcctgcgtctctcacttctttgaggttggggaaagcctagtccagaaaatgaaaacccatagaccagcctaacttcctttcaaccaagtgacggcctcctggttcctctcagttcatcatcaaaatcagtgtgtacatgtcatacaagccaagagtgttcatgtcctcgttcctttcaaatgaaggtgatatatactttttcactgagtttttattcctgaaattctttcttctggagcaggaagcaaatgtcctggaatcgtagacttttacagtcagaagggtcattcacgttcatctagtgcccctctcactctgcagggatcctcctgcctctcctctgcccctgtccagtgcctggtggtccagcctgtgatgggcaggcctaggctgccatccgcaggctctgtagttctgctttctattgaaccaagatgtttctacgttgcctattggtcgtggttctgtccagagcagttcaggctggggctgttcacttgcccctccttgaggcagacctttagatattttcagttttcatcacatgtctaacaccacttccaccccacccctcacctcttaggctaaatccaagctaaatcccccaatgtcttttttttttttttttttttgagacgagtctcatctgtcacccaggctggagtgcaatggcatggtctcggctcactgcaacctccgcctcctgggttcaagctattctgcctcagcctcccaaggagccaggactacaggtgcatgccaccacgcccggctaatttttgtattttttagtagagacagggtttcacccagccattgagacaagctggtttcaaactcctgaccttgtggtccgcccgccccggcctcccagagtgctgggattacaggcgtgagccaccgcgcccatctcccctgcaatgtctttagttagaccttttccaccatcatgtctaactgggctacggtttggggaaagtgtccaaattagtccgtgttatcctaaaaggggtgtgccccggattagcagggccagggctagggtgagacaaatgaggcacctggggcatacatttaagttggtgcttgcttgcaggtgccaagagagtgcttccttgggtttacccccgtggtgcctcctttacctcattctggccccagccctggggttagagtcgcaccagtgtggtccaagtggcataattatctccctaaatgcttgggcagcatcagctttcagtagctgtgccccatgggaggcacattaagctagtggcaagttgagactgcagacctcagcttaatatcagttgttgcccaagacagatctcaccccacatcttcatgacaggcctaacaacaaggcactttgcccttaatcctctactactgcctgctcttcattttgggccaactgtacagctcattttgagatagtagctgatcatttttctgatcagttaactttgtcttattaagcaaaatggagaatataatgttgggaaataagtgtgttgattaaaagaaagtatccccttctaccatcttccatttgtgtctgggttgtgctgggtaaagttctagacttactaacgcagacttcattttggtccggtttccacagcatgcctcgggcatcagtgtccaggagtagctgtatttgaggtttccttcactctggtaggttcctgattcctgatgaaaataacttgaaaaaaaaataattatactactgatcctcttttgggataatgaaattgcgaaggaatgttgttgattataacttttattttttaatgtacagatgtactgtctctcattgagcactgatagaatttatttttctttcaatagtttaaaatcacttatgtggagacacatacttaagtgtgttcaactcgttttcttcccacatatctagtgtgacctttaaaaaccacaactttattttggacattaaatgtgcaatattcactacttattcattgttccacatttttcatacttgtacaaagggtaagtttttatataatggtgagaaacaggaagaaatgacaactggttaagtaaaattctgcaaataaactagattcgaatttaattta

SEQ ID NO: 129118 - DNA, 3767 bp, Homo sapiens
  Payload ID: 5257
  Gene Symbol: EPG5
  Gene Name: ectopic P-granules autophagy protein 5 homolog (C. elegans)
  ENST ID: ENST00000590884
  CDS Start-End: 9-1982
tcaacagcatgatccaggcacacatatctgtaagcactcagcccaatgaagtgggccccgttgctgtgttggagttctgggttcaggctctcataagccagcatctctggtaccgagaacaacctatcctcttcctcatggaccacttgtgtaaagcagcttttcagctgatgcaggaagactgcatacagaaattactctaccaacaacataagaatgccttgggttaccactgtgaccggagtctgctctcatctttggtaagctggattgtggcaggcaacatcactccttcctttgtggagggcttggccacgcccactcaggtctggtttgcctggacagtgctcaacatggaatccatctttgaagaggactcccagctccggagagttattgaaggggaattggtgataaactctgctttcacccctgaccaagctctgaagaaagcccagacccagctgaagctccccatcgtgccatccctccagaggctgctgatttatcgctgggcccaccaggctctggtcacaccttctgatcaccccctcctgccactcatttggcagaagttcttccttctgtatcttcaccgtccgggaccacagtatgggttacccatagatggttgtattggaagaaggttttttcaaagtcctgctcatatcaatttgttgaaagaaatgaagagacgtttgaccgaggtggctgacttccaccatgctgcaagcaaggccctccgtgttccagcagagggcagtgaagggctgccagagagccactctggcacccctggttacctgacttcaccagaactgcacaaggagctggtgaggctcttcaatgtatatatattatggctagaagatgagaattttcaaaaaggagatacctatatcccttctctaccaaagcattatgatattcacaggctagcaaaagtgatgcagaatcagcaggatctgtggatggagtatttgaacatggagcgcatctatcatgagtttcaggagactgttggtctgtggacacaggccaagcttgagtcccattccacaccctgcagtttgtccgtgcagctggacttcactgatcctttgctggctaaagaaagggttttaagtaacttgcggaagcatgaggctccccagcctccccttgctctgcacccgacgaagcctcctgtgccagttatttcctctgctgtgctattgagtcagaaggacgccacccagctggtgtgcacagacctgaatctgttgcaacagcaggccagaaccgcagctcttcgggaatctcagcaggttgctctggatggtgagctgttagacacaatgccaaagcagtatgtgaatcgtgaagaacagaccacactacatttggagtgcagaggcagcagcggtaagaaatgccaaggagccgcagttgtcacggttcagtttgaaggcatgcataagaatgaagccataagccaacagcttcatgttttacggaaggaagtgaagcagttgcaagcagaagctgctaaaccaccatcacttaatattgtggaagctgctgtacatgcagaaaacttgatcacggccttagtgaatgcctacaagttgcagcctacacctgggattcagaaagttggcattagccttttctttactattgtggattacgtcagcgatgagacgcagcgtcatcccccaacaaggcagttctttacttcatgtattgagatcttgggacaggtatttatcagtggcattaaatcagagtgcagaaaagtacttgaaaccattctgaagaacagcaggctctgctccctgctgtctcctttcttcactcccaatgctgcacctgcagagttcatacagctgtatgagcaagtggtgaagtttctaagtgaggacaacagtgatatgattttcatgctgctaaccaaggcttctggagtccattcacttggcacttactgcctggggccttgaaccagatgaggatattttgatgccatttaatcttttctgtaagcactggacttatcttcttctctaccagtttcctgaccagtacagtgacattctcaggctgcttatgcaaagctccgcggagcagcttctgagccccgagtgttggaaggccactctgagagccctgggctgctgcgcccccagctgccagcagggggcagcgtccaccgagggcgccgtgcttcccagctcttctgatgctctcttgtcagacaagcaggtaatggagactatacagtggctttcagactttttttataagcttcggttatccaagatggactttaaaagctttggtttattctcaaaatggagtccttatatggctgatgtgaagacattcttgggctaccttgtgaaaaggctgattgacttagaaatgacctgtttggcccaagacccaactgccagcaggaaaacagtgctgaaatccctacattcagtaatcattcagctctttaagccatggatcctggttttagaggacaacgaaaggtggaacgaggaagccccaagagctgtttcttatttttggggtctgtactctgtgaagtcaactgggttagtgtgctctctgatgcctggaattccagtccccacccagaaacccgcagcatgattgtctgcctccttttcatgatgattttattggcaaaggaagttcaactggtagaccaaacagattcacctttacttagtctccttggacagacaagctcactttcatggcatcttgtggatattgtgtcgtaccagagtgtgctaagttatttcagcagccattacccgccgtccatcatcctggcaaaagaatcttatgctgaattaatcatgaagctcctaaaagtgtctgcgggcctttctattcctactgacagccagaagcatcttgatgcagttccaaaatgccaagcttttactcatcagatggttcaattcctcagcaccctggaacaaaatggaaaaatcaccttagcagtcctagaacaggaaatgtctaagctcttagacgatatcattgtctttaacccgcccgacatggacagccagacccgccacatggccctcagcagcctctttatggaagtcctgatgatgatgaacaacgcgactattccaacagcagagttccttcggggcagtatccggacctggattggccaaaaaatgcatgggctggtggtgctgccccttttaacagcagcctgccagagcctggcgtccgtccgccacatggctgagactacagaagcctgcatcactgcctacttcaaagaaagccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaagctccgtggaggaagaggcaaagctgtttttgtggtggcaccaagtccttcagctctccctcattcagacagagcagaatgactccgtcctgacagaatctgtcattcgaattctgctcttggttcagagcaggcagaacctcgtggctgaggagagactcagctctgggatcctgggggcaattgggtttggccggaagtcgcctttgtctaacaggtaaggaagcgcctttctaacactgttgttc

SEQ ID NO: 129119 - DNA, 4232 bp, Homo sapiens
  Payload ID: 5257
  Gene Symbol: EPG5
  Gene Name: ectopic P-granules autophagy protein 5 homolog (C. elegans)
  ENST ID: ENST00000587884
  CDS Start-End: 9-1019
tcaacagcatgatccaggcacacatatctgtaagcactcagcccaatgaagtgggccccgttgctgtgttggagttctgggttcaggctctcataagccagcatctctggtaccgagaacaacctatcctcttcctcatggaccacttgtgtaaagcagcttttcagctgatgcaggaagactgcatacagaaattactctaccaacaacataagaatgccttgggttaccactgtgaccggagtctgctctcatctttggtaagctggattgtggcaggcaacatcactccttcctttgtggagggcttggccacgcccactcaggtctggtttgcctggacagtgctcaacatggaatccatctttgaagaggactcccagctccggagagttattgaaggggaattggtgataaactctgctttcacccctgaccaagctctgaagaaagcccagacccagctgaagctccccatcgtgccatccctccagaggctgctgatttatcgctgggcccaccaggctctggtcacaccttctgatcaccccctcctgccactcatttggcagaagttcttccttctgtatcttcaccgtccgggaccacagtatgggttacccatagatggttgtattggaagaaggttttttcaaagtcctgctcatatcaatttgttgaaagaaatgaagagacgtttgaccgaggtggctgacttccaccatgctgcaagcaaggccctccgtgttccagcagagggcagtgaagggctgccagagagccactctggcacccctggttacctgacttcaccagaactgcacaaggagctggtgaggctcttcaatgtatatatattatggctagaagatgagaattttcaaaaaggagatacctatatcccttctctaccaaagcattatgatattcacaggctagcaaaagtgatgcagaatcagcagggctgcagtcttttgagtattgaccccagcaccaggatgggatttaggaaactctaagagttgaaacactttcatttggatccttaaaccctcctactttcacatcatgtgtatattttatctccagatctgtggatggagtatttgaacatggagcgcatctatcatgagtttcaggagactgttggtctgtggacacaggccaagcttgagtcccattccacaccctgcagtttgtccgtgcagctggacttcactgatcctttgctggctaaagaaagggttttaagtaacttgcggaagcatgaggctccccagcctccccttgctctgcacccgacgaagcctcctgtgccagttatttcctctgctgtgctattgagtcagaaggacgccacccagctggtgtgcacagacctgaatctgttgcaacagcaggccagaaccgcagctcttcgggaatctcagcaggttgctctggatggtgagctgttagacacaatgccaaagcagtatgtgaatcgtgaagaacagaccacactacatttggagtgcagaggcagcagcggtaagaaatgccaaggagccgcagttgtcacggttcagtttgaaggcatgcataagaatgaagccataagccaacagcttcatgttttacggaaggaagtgaagcagttgcaagcagaagctgctaaaccaccatcacttaatattgtggaagctgctgtacatgcagaaaacttgatcacggccttagtgaatgcctacaagttgcagcctacacctgggattcagaaagttggcattagccttttctttactattgtggattacgtcagcgatgagacgcagcgtcatcccccaacaaggcagttctttacttcatgtattgagatcttgggacaggtatttatcagtggcattaaatcagagtgcagaaaagtacttgaaaccattctgaagaacagcaggctctgctccctgctgtctcctttcttcactcccaatgctgcacctgcagagttcatacagctgtatgagcaagtggtgaagtttctaagtgaggacaacagtgatatgattttcatgctgctaaccaagttcgatcttaaacaatggttaagcgccactaaacctcctctgtctgatcgtaccaggcttctggagtccattcacttggcacttactgcctggggccttgaaccagatgaggatattttgatgccatttaatcttttctgtaagcactggacttatcttcttctctaccagtttcctgaccagtacagtgacattctcaggctgcttatgcaaagctccgcggagcagcttctgagccccgagtgttggaaggccactctgagagccctgggctgctgcgcccccagctgccagcagggggcagcgtccaccgagggcgccgtgcttcccagctcttctgatgctctcttgtcagacaagcaggtaatggagactatacagtggctttcagactttttttataagcttcggttatccaagatggactttaaaagctttggtttattctcaaaatggagtccttatatggctgatgtgaagacattcttgggctaccttgtgaaaaggctgattgacttagaaatgacctgtttggcccaagacccaactgccagcaggaaaacagtgctgaaatccctacattcagtaatcattcagctctttaagccatggatcctggttttagaggacaacgaaagcagccaacagcggcattacccctggctagagagtgatactgtggtggcctcaagcattgtgcagctgttcactgactgtattgactcactgcatgagagttttaaagataagctgttgccaggtgatgcaggagccctttggttgcacctgatgcattattgtgaagcatgtacagcacccaaaatgccagagttcattctgtacgctttccatagcacgtaccggaaactgccatggaaggacctgcaccctgaccagatgctcatggaggccttcttcaaagtggaacgaggaagccccaagagctgtttcttatttttggggtctgtactctgtgaagtcaactgggttagtgtgctctctgatgcctggaattccagtccccacccagaaacccgcagcatgattgtctgcctccttttcatgatgattttattggcaaaggaagttcaactggtagaccaaacagattcacctttacttagtctccttggacagacaagctcactttcatggcatcttgtggatattgtgtcgtaccagagtgtgctaagttatttcagcagccattacccgccgtccatcatcctggcaaaagaatcttatgctgaattaatcatgaagctcctaaaagtgtctgcgggcctttctattcctactgacagccagaagcatcttgatgcagttccaaaatgccaagcttttactcatcagatggttcaattcctcagcaccctggaacaaaatggaaaaatcaccttagcagtcctagaacaggaaatgtctaagctcttagacgatatcattgtctttaacccgcccgacatggacagccagacccgccacatggccctcagcagcctctttatggaagtcctgatgatgatgaacaacgcgactattccaacagcagagttccttcggggcagtatccggacctggattggccaaaaaatgcatgggctggtggtgctgccccttttaacagcagcctgccagagcctggcgtccgtccgccacatggctgagactacagaagcctgcatcactgcctacttcaaagaaagccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaagctccgtggaggaagaggcaaagctgtttttgtggtggcaccaagtccttcagctctccctcattcagacagagcagaatgactccgtcctgacagaatctgtcattcgaattctgctcttggttcagagcaggcagaacctcgtggctgaggagagactcagctctgggatcctgggggcaattgggtttggccggaagtcgcctttgtctaacaggtaaggaagcgcctttctaacactgttgttc

SEQ ID NO: 129120 - DNA, 6375 bp, Homo sapiens
  Payload ID: 5257
  Gene Symbol: EPG5
  Gene Name: ectopic P-granules autophagy protein 5 homolog (C. elegans)
  ENST ID: ENST00000590854
  CDS Start-End: 1-1517
aggtggaacgaggaagccccaagagctgtttcttatttttggggtctgtactctgtgaagtcaactgggttagtgtgctctctgatgcctggaattccagtccccacccagaaacccgcagcatgattgtctgcctccttttcatgatgattttattggcaaaggaagttcaactggtagaccaaacagattcacctttacttagtctccttggacagacaagctcactttcatggcatcttgtggatattgtgtcgtaccagagtgtgctaagttatttcagcagccattacccgccgtccatcatcctggcaaaagaatcttatgctgaattaatcatgaagctcctaaaagtgtctgcgggcctttctattcctactgacagccagaagcatcttgatgcagttccaaaatgccaagcttttactcatcagatggttcaattcctcagcaccctggaacaaaatggaaaaatcaccttagcagtcctagaacaggaaatgtctaagctcttagacgatatcattgtctttaacccgcccgacatggacagccagacccgccacatggccctcagcagcctctttatggaagtcctgatgatgatgaacaacgcgactattccaacagcagagttccttcggggcagtatccggacctggattggccaaaaaatgcatgggctggtggtgctgccccttttaacagcagcctgccagagcctggcgtccgtccgccacatggctgagactacagaagcctgcatcactgcctacttcaaagaaagccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaagctccgtggaggaagaggcaaagctgtttttgtggtggcaccaagtccttcagctctccctcattcagacagagcagaatgactccgtcctgacagaatctgtcattcgaattctgctcttggttcagagcaggcagaacctcgtggctgaggagagactcagctctgggatcctgggggcaattgggtttggccggaagtcgcctttgtctaacaggttccgagtggttgcccgaagcatggctgccttcctttcagttcaggttcctatggaagatcagatccgtttgaggcctggctctgaattacatctgacccccaaagctcagcaggctctgaatgctcttgaatccatggcatcaagtaagcagtatgttgaataccaggatcaaatattgcaagccacccaatttataaggcatcctggccattgccttcaagatgggaaaagcttcttggctcttctcgttaactgtctgtatccagaagtgcattatttggaccacatacgatagttaacactgaggctcttgaaaaacccattgctgtttatgtttacatttaactttgctgttgcacaagtaactttgctcaattgcactgtagagctcagtttggccaatgtgtagttgactgagatgcaagttgggaggcgttagatattagataattttggggtgtgtgtgtgtgtgtgtgtgtgttttcttagctcttaagaccttctggggactctttaagtttttatatttatccacaagagaaacttactaagttccacttgggtgcagagccactcacagttgccgaatgtcccagtcatctcacaagacctccagatggagttctttgtatgtttccacttctgtctctgttttatgtaaatgttccagatctgacaaccttggaagtcactcagtacccttacttttaaaccccatttgtgttcctccaaagtaaagaagtcaattttgaaaaatttctgcatttctcaaatgtggacaaatacaatagttttaaagtattgtttttctcagaagggagataaaaatgccgagttagttaaagtgggtcatgtgtaaaatacgaccacttgatcgtgattatagtgggcagtagagatgatgacaagtcaatttccatccagccgtgtatcctcatggagaagctgcctgtctgaatcaggatggcaagctggcagtctgggaggagcatgttttgcacagatgttttgtttggtccacttggtgaggagtgcagacagggctgcctctctctagtcgggagagtctgtgcattccctcgggccctgaccctagcctcattcacatcacttgcccctgtcgacacctaagtttgcaccctttgatagacaccatgttcgatatctgaaaggctcagtgtcaggagacagagactgagggagactgaagacctgattctctgttccctgcttgttttttaacttcaaactcagatgaagccaatggacctgctgaaacacttgtctgtggaaactgggtcaggtcgggagatctactgaaatttggctttttttccatagccacgtgccttctgttgttgacagttcattcattaccaaagcctgtgtgtaactttgccttgttctgtggccatcttcttgctcatgttatttctcctgggaatgagcagtttgacttctgttcccacgttcctcattctatcagctctagatggattttgcctgcatagctggcttaatatgtctttgtgtatgggtagtctgtagcctgagaatatttacctaaaaatgtctaaacagccaccaagaatgtttataggggtataggaatatagttaacagagtgctaatctctcctcaaatgtccttttggaatgcttcccccaaaattgggaagttggtaggagcttttctttactttgaatttctttacttggacagaacgattctgccttaaagacacgctttgcagctctgataaagaacatccctgtttagtctcttgagttttacaggccacaaaatgtccgtctcagagggatctgtctcagcttttcttatttttgcttctctccgttttcaaaattaatcatcttgttctctgtataagaaaatttgagaagctgtggacaatttaatagtctgatctggcaacagcgatttttgtttggaaatattttgtgttttctttgaggaggatataattactgatatcctaggatgtgaaatttttgagtgacagtatgcacattttaaagaaaattatgattaatctgtataatgttttttggtctgtaaaaattataaaaaataaaatcatttatctttggttgtaactgtttaaaaaccaaattatagggatatcacactatcttgtaaagtgtttcagctgttaaagttgctgtaggtttttatgcctgatgtcatttaatttatttgacattgaacttcattaataatcagagatggtcagtgaaagcgcttcctctttaactctttcttgcttaaccttggaaggttgactcaactcctaggtgtctatgggaaactctgggctaggaacgtgctataaagacactgagctagttcagacatggccatgctgctgtagcctcctgggaaagaagggcggcagagagaccagcccgcctgttggcttgcaggggtaatgagccttggcttgaaaaaattgttggcctccagagagcacggggctgtggtttcagaatcagtgatgggtgccgcacatcaagacgggaatcaagcaagaccaaggccctgtggactgagcagcgtggagggcgaacggctgcaggctccagacttcaccacagggtggccaacagtggcatcgggaccaaataaagatgtctaacagcttcctgggagcaggaggaggcaggattctggttgccatgaaaaacatctctctccctctccatcactccccatgctgcagtgcacaggtgggttgcagaggcaggctgcatcccggaatcatgttgtcccactgcctattaatagaacaagtgaagggcagaatgctggaacacaccagacatagagggagggaggtcctgccagatgtgtctacacaactgtctacatagcatgacagtagcagtggattcgggacccacctgtacatgtttccaaagctccttcctgcacactcgggacctcagctccaaggcgtgactcatttctcagtctcaccatcctttgttggctcagacatcgcatgcctctgccccactggggttgtgtgcctgcgtctctcacttctttgaggttggggaaagcctagtccagaaaatgaaaacccatagaccagcctaacttcctttcaaccaagtgacggcctcctggttcctctcagttcatcatcaaaatcagtgtgtacatgtcatacaagccaagagtgttcatgtcctcgttcctttcaaatgaaggtgatatatactttttcactgagtttttattcctgaaattctttcttctggagcaggaagcaaatgtcctggaatcgtagacttttacagtcagaagggtcattcacgttcatctagtgcccctctcactctgcagggatcctcctgcctctcctctgcccctgtccagtgcctggtggtccagcctgtgatgggcaggcctaggctgccatccgcaggctctgtagttctgctttctattgaaccaagatgtttctacgttgcctattggtcgtggttctgtccagagcagttcaggctggggctgttcacttgcccctccttgaggcagacctttagatattttcagttttcatcacatgtctaacaccacttccaccccacccctcacctcttaggctaaatccaagctaaatcccccaatgtcttttttttttttttttttttgagacgagtctcatctgtcacccaggctggagtgcaatggcatggtctcggctcactgcaacctccgcctcctgggttcaagctattctgcctcagcctcccaaggagccaggactacaggtgcatgccaccacgcccggctaatttttgtattttttagtagagacagggtttcacccagccattgagacaagctggtttcaaactcctgaccttgtggtccgcccgccccggcctcccagagtgctgggattacaggcgtgagccaccgcgcccatctcccctgcaatgtctttagttagaccttttccaccatcatgtctaactgggctacggtttggggaaagtgtccaaattagtccgtgttatcctaaaaggggtgtgccccggattagcagggccagggctagggtgagacaaatgaggcacctggggcatacatttaagttggtgcttgcttgcaggtgccaagagagtgcttccttgggtttacccccgtggtgcctcctttacctcattctggccccagccctggggttagagtcgcaccagtgtggtccaagtggcataattatctccctaaatgcttgggcagcatcagctttcagtagctgtgccccatgggaggcacattaagctagtggcaagttgagactgcagacctcagcttaatatcagttgttgcccaagacagatctcaccccacatcttcatgacaggcctaacaacaaggcactttgcccttaatcctctactactgcctgctcttcattttgggccaactgtacagctcattttgagatagtagctgatcatttttctgatcagttaactttgtcttattaagcaaaatggagaatataatgttgggaaataagtgtgttgattaaaagaaagtatccccttctaccatcttccatttgtgtctgggttgtgctgggtaaagttctagacttactaacgcagacttcattttggtccggtttccacagcatgcctcgggcatcagtgtccaggagtagctgtatttgaggtttccttcactctggtaggttcctgattcctgatgaaaataacttgaaaaaaaaataattatactactgatcctcttttgggataatgaaattgcgaaggaatgttgttgattataacttttattttttaatgtacagatgtactgtctctcattgagcactgatagaatttatttttctttcaatagtttaaaatcacttatgtggagacacatacttaagtgtgttcaactcgttttcttcccacatatctagtgtgacctttaaaaaccacaactttattttggacattaaatgtgcaatattcactacttattcattgttccacatttttcatacttgtacaaagggtaagtttttatataatggtgagaaacaggaagaaatgacaactggttaagtaaaattctgcaaataaactagattcgaatttaattta

SEQ ID NO: 129121 - DNA, 3999 bp, Homo sapiens
  Payload ID: 5257
  Gene Symbol: EPG5
  Gene Name: ectopic P-granules autophagy protein 5 homolog (C. elegans)
  ENST ID: ENST00000592272
  CDS Start-End: 9-2579
tcaacagcatgatccaggcacacatatctgtaagcactcagcccaatgaagtgggccccgttgctgtgttggagttctgggttcaggctctcataagccagcatctctggtaccgagaacaacctatcctcttcctcatggaccacttgtgtaaagcagcttttcagctgatgcaggaagactgcatacagaaattactctaccaacaacataagaatgccttgggttaccactgtgaccggagtctgctctcatctttggtaagctggattgtggcaggcaacatcactccttcctttgtggagggcttggccacgcccactcaggtctggtttgcctggacagtgctcaacatggaatccatctttgaagaggactcccagctccggagagttattgaaggggaattggtgataaactctgctttcacccctgaccaagctctgaagaaagcccagacccagctgaagctccccatcgtgccatccctccagaggctgctgatttatcgctgggcccaccaggctctggtcacaccttctgatcaccccctcctgccactcatttggcagaagttcttccttctgtatcttcaccgtccgggaccacagtatgggttacccatagatggttgtattggaagaaggttttttcaaagtcctgctcatatcaatttgttgaaagaaatgaagagacgtttgaccgaggtggctgacttccaccatgctgcaagcaaggccctccgtgttccagcagagggcagtgaagggctgccagagagccactctggcacccctggttacctgacttcaccagaactgcacaaggagctggtgaggctcttcaatgtatatatattatggctagaagatgagaattttcaaaaaggagatacctatatcccttctctaccaaagcattatgatattcacaggctagcaaaagtgatgcagaatcagcaggatctgtggatggagtatttgaacatggagcgcatctatcatgagtttcaggagactgttggtctgtggacacaggccaagcttgagtcccattccacaccctgcagtttgtccgtgcagctggacttcactgatcctttgctggctaaagaaagggttttaagtaacttgcggaagcatgaggctccccagcctccccttgctctgcacccgacgaagcctcctgtgccagttatttcctctgctgtgctattgagtcagaaggacgccacccagctggtgtgcacagacctgaatctgttgcaacagcaggccagaaccgcagctcttcgggaatctcagcaggttgctctggatggtgagctgttagacacaatgccaaagcagtatgtgaatcgtgaagaacagaccacactacatttggagtgcagaggcagcagcggtaagaaatgccaaggagccgcagttgtcacggttcagtttgaaggcatgcataagaatgaagccataagccaacagcttcatgttttacggaaggaagtgaagcagttgcaagcagaagctgctaaaccaccatcacttaatattgtggaagctgctgtacatgcagaaaacttgatcacggccttagtgaatgcctacaagttgcagcctacacctgggattcagaaagttggcattagccttttctttactattgtggattacgtcagcgatgagacgcagcgtcatcccccaacaaggcagttctttacttcatgtattgagatcttgggacaggtatttatcagtggcattaaatcagagtgcagaaaagtacttgaaaccattctgaagaacagcaggctctgctccctgctgtctcctttcttcactcccaatgctgcacctgcagagttcatacagctgtatgagcaagtggtgaagtttctaagtgaggacaacagtgatatgattttcatgctgctaaccaagttcgatcttaaacaatggttaagcgccactaaacctcctctgtctgatcgtaccaggcttctggagtccattcacttggcacttactgcctggggccttgaaccagatgaggatattttgatgccatttaatcttttctgtaagcactggacttatcttcttctctaccagtttcctgaccagtacagtgacattctcaggctgcttatgcaaagctccgcggagcagcttctgagccccgagtgttggaaggccactctgagagccctgggctgctgcgcccccagctgccagcagggggcagcgtccaccgagggcgccgtgcttcccagctcttctgatgctctcttgtcagacaagcaggtaatggagactatacagtggctttcagactttttttataagcttcggttatccaagatggactttaaaagctttggtttattctcaaaatggagtccttatatggctgatgtgaagacattcttgggctaccttgtgaaaaggctgattgacttagaaatgacctgtttggcccaagacccaactgccagcaggaaaacagtgctgaaatccctacattcagtaatcattcagctctttaagccatggatcctggttttagaggacaacgaaagataagctgttgccaggtgatgcaggagccctttggttgcacctgatgcattattgtgaagcatgtacagcacccaaaatgccagagttcattctgtacgctttccatagcacgtaccggaaactgccatggaaggacctgcaccctgaccagatgctcatggaggccttcttcaaagtggaacgaggaagccccaagagctgtttcttatttttggggtctgtactctgtgaagtcaactgggttagtgtgctctctgatgcctggaattccagtccccacccagaaacccgcagcatgattgtctgcctccttttcatgatgattttattggcaaaggaagttcaactggtagaccaaacagattcacctttacttagtctccttggacagacaagctcactttcatggcatcttgtggatattgtgtcgtaccagagtgtgctaagttatttcagcagccattacccgccgtccatcatcctggcaaaagaatcttatgctgaattaatcatgaagctcctaaaagtgtctgcgggcctttctattcctactgacagccagaagcatcttgatgcagttccaaaatgccaagcttttactcatcagatggttcaattcctcagcaccctggaacaaaatggaaaaatcaccttagcagtcctagaacaggaaatgtctaagctcttagacgatatcattgtctttaacccgcccgacatggacagccagacccgccacatggccctcagcagcctctttatggaagtcctgatgatgatgaacaacgcgactattccaacagcagagttccttcggggcagtatccggacctggattggccaaaaaatgcatgggctggtggtgctgccccttttaacagcagcctgccagagcctggcgtccgtccgccacatggctgagactacagaagcctgcatcactgcctacttcaaagaaagccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaagctccgtggaggaagaggcaaagctgtttttgtggtggcaccaagtccttcagctctccctcattcagacagagcagaatgactccgtcctgacagaatctgtcattcgaattctgctcttggttcagagcaggcagaacctcgtggctgaggagagactcagctctgggatcctgggggcaattgggtttggccggaagtcgcctttgtctaacaggtaaggaagcgcctttctaacactgttgttc

SEQ ID NO: 129122 - DNA, 858 bp, Homo sapiens
  Payload ID: 5258
  Gene Symbol: EDARADD
  Gene Name: EDAR-associated death domain
  Uniprot ID: Q8WWZ3
  ENST ID: ENST00000334232
  CDS Start-End: 168-815
ccgaaggcagaccaagaggaagtttatcctcccacctacaaattccccagagagctttcatctagaaggtttgactctggccagacaaccagcgagcatcttctcgcaatctgttgcttcttccatggcaaactccagagaattaagaagccaaactcaacatcgccatgggcctcaggacgactaaacagatggggagaggcactaaagctcctggtcaccaagaggatcatatggtaaaggaaccagtggaagacacagaccctagcactttatcctttaatatgtcagacaaatatcccattcaagatacggaactccctaaagctgaagaatgtgatacaattactttgaactgcccacgaaattcagatatgaaaaatcagggagaagaaaatggctttccagatagcactggagatcctcttccagagatcagcaaggacaactcctgcaaagaaaactgtacttgttcctcctgcttgctccgggcccccaccataagtgacttgctcaatgatcaggacttactagacgtgatcaggataaagctggatccgtgtcacccaacggtgaaaaactggaggaattttgcaagcaaatgggggatgtcctatgacgaattgtgcttcctggagcagaggccacagagccccaccttggagttcttgctccggaacagtcagaggacggtgggccagctgatggagctctgcaggctctaccacagggccgacgtggagaaggttctgcgcaggtgggtggacgaggagtggcccaagcgggagcgtggagacccctccaggcacttctagagctcttcttcttccttcattggcctctccggatgttgaaaca

SEQ ID NO: 129123 - DNA, 3097 bp, Homo sapiens
  Payload ID: 5258
  Gene Symbol: EDARADD
  Gene Name: EDAR-associated death domain
  Uniprot ID: Q8WWZ3
  ENST ID: ENST00000359362
  CDS Start-End: 215-832
aattgccaaagcaggaagtgagctcgtggaagaagcgaaggaggagaagaagaagggaggggaaggcggaggagggcaggggcgcgcagagccacggtttgctccaggcgcgtcggaaccgcaggacttttcatccccgtggtcccacggtcctcccgcgccccggaggcctgccagccccgctcggacgctcgtttgcccctaacccgccgccatggcttcaccggacgaccctctgcgcgcagatcatatggtaaaggaaccagtggaagacacagaccctagcactttatcctttaatatgtcagacaaatatcccattcaagatacggaactccctaaagctgaagaatgtgatacaattactttgaactgcccacgaaattcagatatgaaaaatcagggagaagaaaatggctttccagatagcactggagatcctcttccagagatcagcaaggacaactcctgcaaagaaaactgtacttgttcctcctgcttgctccgggcccccaccataagtgacttgctcaatgatcaggacttactagacgtgatcaggataaagctggatccgtgtcacccaacggtgaaaaactggaggaattttgcaagcaaatgggggatgtcctatgacgaattgtgcttcctggagcagaggccacagagccccaccttggagttcttgctccggaacagtcagaggacggtgggccagctgatggagctctgcaggctctaccacagggccgacgtggagaaggttctgcgcaggtgggtggacgaggagtggcccaagcgggagcgtggagacccctccaggcacttctagagctcttcttcttccttcattggcctctccggatgttgaaacaaccacaggtcaagaaggaatgtgaatctgttgttttataagagtttaggacaaggacgtggaacagtggacactggttttccccaaagctggcagttttgtggaggggtagcttgtttcggtggtggatctctgtttatttttgcacatctgttataatttaatattcaaatctggaattaagaaaacatattttctagtatcctctaagggccaaagtcctacaatcggaatggattcatgccacgttgaagataaaattatcctctctctgaaatacggtaaagatttaaataggtcctgagactgttgatagccccagacatacccacagcattatatgtaacatctctcctgatcagtgccattcccacggtttcaaagaaaacagctacaaggaatgcttacctgagtgtctgcagcaccctccacttctctcctaggcaatgagacccagtggctagaaattcaccatgtctattctcaagatccatgccagggagctctttgactctcgtgggaatcccactgttgaggttgatctcttcacctcagaaggtctcttcagagctgctgtgcccagtggtgcttcaactggtatctatgaggtcctagagctccaggacaatgataagactcgctatatggggaagggtgtctcaaagcctgttgagcccatcaataaaactattgcacctgtcctggttagcaagaaactgaacgtcacagaacaagagaagattgacaaacttatgatagagatggatggaacagaaaataaatctaaatttggtgcaaatgccattctgggagtgtccctcgctgcctgcaaagctagtgctgttgagaagggggttcccctgtaccaccacatcgccgacttgtctggcaactccaaagtcatcttgccagtcccggtgttcaatgtcatcaatggcagttctcatgctgtcaccaagctggccatgcaggagttcatggtcctcccagtcggtgcagcaaacttcagggaagccatgcccattggagcggaggtttaccacagcctgaagaatgtcatcaaggagaaatatgggaaagatgccaccggtgtgggggatggaggcgcgtttgctcccaacatcctggagaataaagaaggcctggagctgctgaagactgcgattgggaaagctggctacactgataaggtgatcgtcagcatggacgtagaggcctccgagttcttcaggtctggaaagtatgacctggaattcaagtttctcgacgaccccaccaggtacatctcacctgactgtctggctgacctgtacaagtccttcatcaaaaactacccagtggtgtctactgaagatccctttgaccaggatgactggggagcttggcagaagttcacggccagtgcaggaatccaggtagtggaggatgatctcagagtgaccaacccaaagaggacagcctcggccgtgaatgagaagaagtgcaactgcctcctgctcaaagtgaaccagattcgctctgtgactgagtcccttcaggcgtgcaagctggcccaggccaatggttggtgtgtcatggtgcctcatcattctggggagactgaaaataccttcatcactgacctggtggtggggctgtgacctgggcagctcaagactggtgccccttgctgatctgagcgcttggccaagtacaaccagctcctcagaattgaagaggagctgggcagcaaggctaagtttgccggcaggaacttcagaaaccccccagccaagtaagctgtgggcaggcaagcccttcagtcacctggtggctaattagacccctccccttgtgtcaactccggcagctcaagacccccgagcaacatttgtaggggccgctgctagttagctacccttgcccaccgccgtggagttcgcacctcttccttagaacttctacagaagcaggttgcagtgagccgagattgcgccactgcacaccagtctggagacagagtgagagtccgtcccagaaaaaaaaaaaaaaaaaaagaacttctacagaagccaagctccctggagccctgttggcagctctagccttgcagtcatgtaattggcccaaatcaccggagccacgtgaccctccagtgtcatctccggggtggccacaggcaagatccccagtgattttgtgctcaaaataaaaagcctcattgacccatgagaaaaaagaaaa

SEQ ID NO: 129124 - DNA, 658 bp, Homo sapiens
  Payload ID: 5258
  Gene Symbol: EDARADD
  Gene Name: EDAR-associated death domain
  ENST ID: ENST00000439430
  CDS Start-End: 407-658
ttctgatcccggacgaccgtaaggtgcaaactcaaagacctacttccaagctgccgtccatgtgctgcccaatgaagctgcaacacgtgaacctctgtggaaggcgcccaccttttctccagtccttctctcactgagtgccctatcaaaatggaagaatccctgaatgaacccatttcaagtttgaattgtggtaaaatattgcaatcccaagtgttggttgcctacagcttcctactgattttggctggtgtctaaaaagaagctttgagagaagaaaaatagctccaagcattctgagctctgtaaagtactcgggaccagagagacaggagtgtgagacttcagtcatgcctgcctccagccctcccctgccccatacctggggtcaattgtttaagatcatatggtaaaggaaccagtggaagacacagaccctagcactttatcctttaatatgtcagacaaatatcccattcaagatacggaactccctaaagctgaagaatgtgatacaattactttgaactgcccacgaaattcagatatgaaaaatcagggagaagaaaatggctttccagatagcactggagatcctcttccagagatcagcaaggacaactcctgcaaagaaaactgtacttgttcctcctgcttg

SEQ ID NO: 129125 - DNA, 768 bp, Homo sapiens
  Payload ID: 5259
  Gene Symbol: EEF1E1-BLOC1S5
  Gene Name: EEF1E1-BLOC1S5 readthrough (NMD candidate)
  ENST ID: ENST00000397456
  CDS Start-End: 10-465
ggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttataatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaagattcatagtgaccacttagtagctagtgagaaacagcatatgctccagtgggacaacttcatgaaggagcaacccaacaaaagggctgaagtggatgaagagc

SEQ ID NO: 129126 - DNA, 2691 bp, Homo sapiens
  Payload ID: 5260
  Gene Symbol: EFCC1
  Gene Name: EF-hand and coiled-coil domain containing 1
  Uniprot ID: Q9HA90
  ENST ID: ENST00000436022
  CDS Start-End: 1-1797
atggagccggtcagcacgggcgcggaggccggcatggagggcgcgggaggtgacccgtaccggcgacctgcgcggcgcacgcagtggctgctgagcgccctggcgcaccactacgggctggaccgcggcgtggagaacgagatcgtggtgctggccaccggcctggaccagtacctgcaggaggtcttccaccacctggactgccgcggcgccggccgtctgccccgcgccgacttccgagcgctctgcgctgtgctggggctgcgcgcggagggggccaccacggccgggcaggcagcaggtgacgggaactccagagatgtgacccccggggatgcggccgctgagttggccacggacggggactcagataccgatgaagaggcgcgcctggcgctgcgcgccgagccgccggagctcaccttccgccagttccacgcgcgcctctgtggctacttcggcacccgtgcggggccccggctgccccgcggcgctctcagcgagcacatcgagacgcagatccgcctgcgccgtccgcgccgccgccgccgcccgccctgcgcgcctggccccgacagcggtcctgactgtgagcgcgttgcgcggctggaggaggagaatagcagcttgcgcgagttggtggaggacctgcgcgccgcgctgcagagcagtgatgcgcgctgcctagcactgcaggtcggactctggaagagccaggcgagcacccacgagatggggcacggcgggccggaggctgcggtgcgggagctgcgtcaggcgcagggcgccctggctgcggcggaggcccgcgctgggcggctgcgccgtggccaggccgaggtgcggcggcgcgcggaggaggcccggcaggtggtgctgcgcagcctgcaccgcgtgcgagagctggaggcgctggcgcaacaggtgcccggcttgcagcgctgggtgcggcggctggaggcggagctgcaacgctacaggtcagaggattcccagctcccaaccccgcagctagccaacccagagccaggagacaagagtaatgaacctgaagatgctgggaccagagacccagaccccactccagagggagcctggcagtcagacagcagctctggaagcagagccctggatgaagtggacgagcagctgttccgctccgtggagggccaggccgcctctgacgaggaggaggtggaggaggagaggtggcaggaggagaagaagacgccggcagccgaggccaagacactgctggcccggctctccagctgcagaggcaggtgtgatgaccagacggcggagaagctcatgacttactttggtcacttcggcggtgccaaccatgcccataccctgggggagctggaggcctgcattgccatgctggtggagcagctgaggactcagggctgcggtgggaggaccctggggacctctgaggaggaggcagagttgcagcagaaggtggaagagaatgagcacctgaggctggagctgcagatggtagagaccgagagggtgcggctgtccctgctggaggagaagctggtggacgtgctgcagctcctgcagaggctccgggacctgaacatatcgaaaagagccctggggaagattttgctgagcacgctggacgctttcagggaccccacccacgagggaaggcccagccctgcagccatcctggatgccctgcaccaagccttggctgcctgccagctgttgcggagacagccctcggcaccagcctctgcagcagctgcgctcaccaaccccctcctcgtctcctgctgaggttactggcccaccctgtgggcaccctgctcagcctgactgcctttggaccagcctccatgatcagcccaaccactgacagctggtctgaccaccgtcacatcatcagaacttgagtctctgctggctccttccaaggttaagcccgagcccagagcctcccattgcagcacctggcagccaccccttcctcgggctcctccacattacctcgcagcccctgcattcctgccaccagagtccacattaaagccctgcagttgctggatcagcctgcacctgatgctgtatctttcccctgccctcagggcagagatgcccactttctgactgagtctgaccccaaatctcttccccagagtttcaggatctcctcccctcccagcactgtctccttcctcccactggcatgcctgctgcaacggagactgggcccaacctttgggatacctggtctgtaggaaagcactccacaccccaggaaatgttgatgactaggaaaggctgagggaattccaaggaaggaacaatcactgtaggctccctggtagaagctggccttgaaccagctctagaggacaggtaggatttagacaggtaaagaaaggagggaagggcatagaatctaaggtaatggcaagagcaaaggtgtggaaccagaggggggccccaggaatgcagtgcttggagcccctgctcctgaacacgcattaactcctgaactgcgagcccctcctcctgaactgcgtcatggggttgcaggaaggagtaggccaagatacccagtctcacctaacttagactgtcattagagagaaagatccattgccaaacagtgccatgggggtgaaaccagtgctaaatggaggtaaaataaagtttgtaagagcccaa

SEQ ID NO: 129127 - DNA, 2051 bp, Homo sapiens
  Payload ID: 5261
  Gene Symbol: EFCAB1
  Gene Name: EF-hand calcium binding domain 1
  Uniprot ID: Q9HAE3
  ENST ID: ENST00000262103
  CDS Start-End: 82-717
ggctcgcgggggtcccgcgagggtctcggtagccgcgcgcccagagacccccgccgcggcccgattctctgagcgccagacatgaaccgcaagaaactgcagaagctgacggacaccttaaccaaaaattgcaagcattttaataaatttgaagtgaactgtcttataaagcttttttatgacttggtgggaggagtagagaggcaaggtctggttgttggactggatcgtaatgcatttcgaaacatcctgcatgtgacatttggaatgacagatgacatgattatggacagagtattccgaggttttgataaagataatgatggctgtgtaaatgtattggagtggattcatggattatcactgtttcttcgaggatctttggaagaaaaaatgaaatattgctttgaagtgtttgatttgaatggtgacggattcatttcaaaggaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaagtgagtaaaaaaggaggcacacacatattgcttattttttctacttagttcagaaaaatgatgttgaattgtgtgtttcagggtgaagatgaggttcacttacatatatcatttaacatcagtgtaagatgcaattaaaatagatggaagacaagaagtcccttattagatgatgggtttggcaagacagttaacttttctacagatgttttatcacatagactatctgtcgaagcacataactggcataaaacctttgggttcattaaatgaatagagagattacataattatgaattgttaatacaaatattctgcatgtcaaaaagaagctgggtgtacactgaaaaatcattgaaactactggatttcctttgaaacaaataatgaagatggcatcaaaagaataagagtattctattgagcattgaaacgcctttctggtaggcattgagggagatctagagagatgaaagatacatggaaatcatattatattgaaatataatatgatttgcattattgtttgaggctttggctaaataacgttactgattgtaagcacctgaaggcaagggttttatccaccacatctttgtctgccatagcatttagtcctctgcatacaatgggctgtccataattactgtagattggactgaaaatcaaaaagtaccacaagataaatgcaaactcttggtgagcagagggagaacatgtactgagtttcttaggtttcatggctaatgcattggcacagctttcagtgtatccctgcagtccttccagatagtccctgccccatgcattgcagatggttgccaaagcccccctctgtcctggcacccagtgttcctccatcctgactccacgtattgcccccttgccactgcctgagtgcaccatagtgtccccatccccccactgcctggagttccccttgtgtacccccttatcagggcacgacctaactgtgccctgctggctgtgacctcctgaagacagacctggcttctccctgcatccagttccccagtatgtgctgtgggcatcctgagaagcctgaaaaagacagggccaggttaggcttgggtgagctgctttctgccttcttggtacacacagtaagcagtggagaggcgtgttacaccgtatctgttctatcctcatctaaatactgagaggctagttgggatagtaaatctttcttactacatatgcattaagtttaagtaaaatagaatattgtgtgaaaaaatgcactgttactaataaatggaataaacagatccatgaaataaaagaaaa

SEQ ID NO: 129128 - DNA, 2286 bp, Homo sapiens
  Payload ID: 5261
  Gene Symbol: EFCAB1
  Gene Name: EF-hand calcium binding domain 1
  Uniprot ID: Q9HAE3
  ENST ID: ENST00000433756
  CDS Start-End: 161-640
cgttgccttggctacaccgtctgttagggccgcgcacgagatcagtaactgagacctcaccgcgttgacccagcaccagggctcgcgggggtcccgcgagggtctcggtagccgcgcgcccagagacccccgccgcggcccgattctctgagcgccagacatgaaccgcaagaaactgcagaagctgacggacaccttaaccaaaaattgcaagcatttattccgaggttttgataaagataatgatggctgtgtaaatgtattggagtggattcatggattatcactgtttcttcgaggatctttggaagaaaaaatgaaatattgctttgaagtgtttgatttgaatggtgacggattcatttcaaaggaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaagtgacaatgtgctatcagccctcactcggtcccggcacctcctcggcctcgaagtccactctgtccgcgcttgaggagcccttcagcctgccactgcactgtgggatcccctctctgggcaggcctaggccagagccggctccctctgcttgtggggaggtgtggatggagaggcgcaggctggaaccggggctgcacgtggtgcttatgggccagcacgagttctgggtgggcgccggctcggcaggccccgcacttggagcggccggctggcctgcgggtgccgccggccccaggcagtgaggggcttagcacccgggccaacagctgcgtagggtgcgctgggtcccccagcactgccggcccgcccaagcagtgctagaattctcactgggcctcagctgcctccccacggggcagggctcgggacttgcatcccgccatgcccaagccccacccgacctgtctgggtgggctcccgctctgcccgaacctccccgacaggcctgccccctgctccacagtgcctggtcccatcaactgcccaagggctgaggagtgcaagtgtgcagcttacagcttactaagcttctctaaaccaatcattttgaattctttgtcaggaaattcaaggatttccatttctttggggttggttactggaaaatcagtcatgtttcattggttttatatgtttcttgtagctttgcatttatatctacacacgaaggagcagtcacctcttccacacttttatgggctgcctttggtggggaaagaccttcacctattggtgggtgtgaaggcaccagctggggtgtgacagctctggctccaggtggatacatcttggactctgggcagcttaatcagctggggtcagcatcagtgaagactgtgggcaccatcagtcataaaaactgtgggtgtccatgatggtgacaaaagctgctggggtcctcagtggcaaaggctactggacttctgctctcctttttccccacagagagaggtcacagccaaaacgatcccctttgttgccaagctgtgccagggtagaagatgaggtgatgcagataaaacgcttccaacacttttatatacagctgtccttggtttgggggtgctttaatgggttcctgcagcttcttcactgtactctggagtattctcagagctatttttgttggcaagtagctgttaaattcttgcttttgttggggagacaagagctgggatctcctagtgtatcatcttgttgatattacttgcctgcttttaatattttaactaatttttctgattacaaaggaattgaggttctctgaagaatatttcagatatttaggaaattttaaaataagatgaaaatattgattaatattctggtataaatccttccagacttttacaatgcatttgtaagtacatctacatttttgcaaagagaatactgtatttttcagatgatcatattgaaaatgcacttttgtcttggtgtactactattttgtgaacattttttgaggtcattatttgtctgtagcttgacttgtaatggctgcctggtattccatcatgactgactttattaaaccactttcatgccattgacatgtc

SEQ ID NO: 129129 - DNA, 613 bp, Homo sapiens
  Payload ID: 5261
  Gene Symbol: EFCAB1
  Gene Name: EF-hand calcium binding domain 1
  ENST ID: ENST00000523008
  CDS Start-End: 1-235
caaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaacactctatgtggagtaccagaaagccaggctaggcctgtttaggagaggtagacatcacctcgcaagcagcatgaagaaattctatttgggaaacaattaagtgtttttttttaactacaggatttaaaaaccaccactgaaaactggtagtcctgcattcttaacctgcaaatatctctgtgtacaagactgcacttgtaagaaaccaggcctgcaattgcttgcaccataaaatcatccaaaacattcactaagttcctactttgtgcaacaccatgagggttaatgtattctaagctggttgtccctgccctaaccccattcaccatgtaaagtgataatttcatgggc

SEQ ID NO: 129130 - DNA, 920 bp, Homo sapiens
  Payload ID: 5261
  Gene Symbol: EFCAB1
  Gene Name: EF-hand calcium binding domain 1
  ENST ID: ENST00000521701
  CDS Start-End: 151-315
gctacaccgtctgttagggccgcgcacgagatcagtaactgagacctcaccgcgttgacccagcaccagggctcgcgggggtcccgcgagggtctcggtagccgcgcgcccagagacccccgccgcggcccgattctctgagcgccagacatgaaccgcaagaaactgcagaagctgacggacaccttaaccaaaaattgcaagcatttattccgaggttttgataaagataatgatggctgtgtaaatgtattggagtggattcatggattatcactgtttcttcgaggatctttggaagaaaaaatgaaatgaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaagtgacaatgtgctatcagccctcactcggtcccggcacctcctcggcctcgaagtccactctgtccgcgcttgaggagcccttcagcctgccactgcactgtgggatcccctctctgggcaggcctaggccagagccggctccctctgcttgtggggaggtgtggatggagaggcgcaggctggaaccggggctgcacgtggtgcttatgggccagcacgagttctgggtgggcgccggctcggcaggccccgcacttggagcggccggctggcctgcgggtgccgccggccccaggcagtgaggggctta

SEQ ID NO: 129131 - DNA, 648 bp, Homo sapiens
  Payload ID: 5261
  Gene Symbol: EFCAB1
  Gene Name: EF-hand calcium binding domain 1
  Uniprot ID: Q9HAE3
  ENST ID: ENST00000523092
  CDS Start-End: 118-597
agtaactgagacctcaccgcgttgacccagcaccagggctcgcgggggtcccgcgagggtctcggtagccgcgcgcccagagacccccgccgcggcccgattctctgagcgccagacatgaaccgcaagaaactgcagaagctgacggacaccttaaccaaaaattgcaagcatttattccgaggttttgataaagataatgatggctgtgtaaatgtattggagtggattcatggattatcactgtttcttcgaggatctttggaagaaaaaatgaaatattgctttgaagtgtttgatttgaatggtgacggattcatttcaaaggaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaagtgagtaaaaaaggaggcacacaca

SEQ ID NO: 129132 - DNA, 639 bp, Homo sapiens
  Payload ID: 5261
  Gene Symbol: EFCAB1
  Gene Name: EF-hand calcium binding domain 1
  ENST ID: ENST00000522254
  CDS Start-End: 1-388
tgtaaatgtattggagtggattcatggattatcactgtttcttcgaggatctttggaagaaaaaatgaaatattgctttgaagtgtttgatttgaatggtgacggattcatttcaaaggaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaaggtgaagatgaggttcacttacatatatcatttaacatcagtgtaagatgcaattaaaatagatggaagacaagaagtcccttattagatgatgggtttggcaagacagttaacttttctacagatgttttatcacatagactatctgtcgaagcacataactggcataaaacctttgggttcattaaatgaatagagagattacataattatgaattgttaata

SEQ ID NO: 129133 - DNA, 1550 bp, Homo sapiens
  Payload ID: 5262
  Gene Symbol: EFCAB10
  Gene Name: EF-hand calcium binding domain 10
  ENST ID: ENST00000486180
  CDS Start-End: 24-419
tagcaacagcgggacgcggagcgatggagaccagcagcagggagctccaagccgcggagtatttggaaaagcatcagatcaaggaggtggttagctacctcaccagcgccctccttttctttcggccggaaaaaccaaaagaatatttaatatctctattggaacgactgagaattgcaaaagtaacaggcgtggcgtttcctttctttatggataactctaacattgtggctatgtttgagatgatggactcctcaggcagaggcaccatatcatttgtgcagtataaagaagccctaaaaaccctgggtctatgcactgaagatgaagatttacaagatgatggacataaaataactttggataaattcaaggaggaagtgaacaagaggatgaaggaaatatggtcagcattttaataacaccataaatccaagataataagtaattctataaagttttccagtttcattaattcagaatttcatcatataacttgaaatccaattggcttcctctttcttagaaacaaaaaccaaagaaacctttttctgaaagacattattttccagtattaggccaatttgtcctcaaattaagtagaatctcaacatcttgttgagccagtttgtaaattccaacttcatttaatgctgctgtggcaggaagctgccctgaagctgactgcagtacatctttcagcagtagtgcagaaccgacgttcaaattcaaaacaatacaggcttcttttatactgtttagggaaaacaaaggagggaaatgagatctccattatctgcatcaattatattacaattttgagaatcctaaacagcttctctgcactgctggtccacatgttctctataaaaatatttatggatttattatttggttcttttaacatggtaagactacacaggtgcagagttgctatttctttagattactataaggtaatacgatccctatttcaatatgtatccgttatttccctaaatacaatacttaatattaacactatattaaatatagctataactttaggtagattagaacatgggaaaagacaaaaataagagataaatgaaagcagcagaaagaacattaaaataaattttaaaaacagtcctatgaaacgtgtaaacataagctttcattttataagtctaaaaggaatgctttataacctcacaaaacccaaacataatttaaattttactttttttttttgagacatggtcttgctctgtcacctaggctggagtgaaactgcacgatcatagctcactacagcctcagcctctcaagtagctaggactacaggtccacacccccacacctggcttttttttgtttgttcattttaatactttctgtagagatggagtcttgctatgttgcccaggctggtctcaaacagctggcctcaagcaattctcccacctctgcctcccaaagtactgggattacagatgtgggctactatgcctggcctataaattttagatcaacaaattctgaaactataattatatttagaaccaaaa

SEQ ID NO: 129134 - DNA, 799 bp, Homo sapiens
  Payload ID: 5262
  Gene Symbol: EFCAB10
  Gene Name: EF-hand calcium binding domain 10
  ENST ID: ENST00000485614
  CDS Start-End: 34-483
ggcagtcgcctagcaacagcgggacgcggagcgatggagaccagcagcagggagctccaagccgcggagtatttggaaaagcatcagatcaaggaggtggttagctacctcaccagcgccctccttttctttcggccggaaaaaccaaaagaatatttaatatctctattggaacgactgagaattgcaaaagtaacaggcgtggcgtttcctttctttatggataactctaacattgtggctatgtttgagatgatggactcctcaggcagaggcaccatatcatttgtgcagtataaagaagccctaaaaaccctgggtctatgcactgaagatgaagatttacaagatgatggacataaaataactttggataaattcaaggaggaagtgaacaagaggatgaaggaaatatgtgagaaaacaaagggaaaagattccgagtcatatcaaactgcagctgggctgctcctccttcattgaagtgattagcaagaattatctgaaacaaagaataattcatataacagttgtctttattatcacagcccaaaaacagtctattcttacttacttcttggtagatgtatacatccagcttctctacaagcatttgccagaaaattttaaataaggagaaacaaagctgctgctccaactgaagtaaatggtctcgtaacgtcagcagcaacgggcaagccgaactggacagggacatcactgcctgctctgactgagatggcaaggacaaccatctggaaaaaacacatttttaccaaaaaattttcatcagtttcta

SEQ ID NO: 129135 - DNA, 717 bp, Homo sapiens
  Payload ID: 5262
  Gene Symbol: EFCAB10
  Gene Name: EF-hand calcium binding domain 10
  ENST ID: ENST00000460135
  CDS Start-End: 228-458
gccctaagcctggatcgcggacagtgacgttggtccacacctcacctgccctctctgccctgctacatgccccaggcttgccctgaaccgtgagctctagaaattccaggtccgggtcgcagccacagggcagtcaggcgtgtcacgtgaccgcgccgggtagagggagacagagtcgcacggctgagacgccaggcagtcgcctagcaacagcgggacgcggagcgatggagaccagcagcagggagctccaagccgcggagtatttggaaaagcatcagatcaaggaggtggttagctacctcaccagcgccctccttttctttcggccggccctaaaaaccctgggtctatgcactgaagatgaagatttacaagatgatggacataaaataactttggataaattcaaggaggaagtgaacaagaggatgaaggaaatatggtcagcattttaataacaccataaatccaagataataagtaattctataaagttttccagtttcattaattcagaatttcatcatataacttgaaatccaattggcttcctctttcttagaaacaaaaaccaaagaaacctttttctgaaagacattattttccagtattaggccaatttgtcctcaaattaagtagaatctcaacatcttgttgagccagtttgtaaattccaacttcatttaatgctgctgtggcaggaagctgccctga

SEQ ID NO: 129136 - DNA, 740 bp, Homo sapiens
  Payload ID: 5262
  Gene Symbol: EFCAB10
  Gene Name: EF-hand calcium binding domain 10
  Uniprot ID: A6NFE3
  ENST ID: ENST00000480514
  CDS Start-End: 38-421
gccaggcagtcgcctagcaacagcgggacgcggagcgatggagaccagcagcagggagctccaagccgcggagtatttggaaaagcatcagatcaaggaggtggttagctacctcaccagcgccctccttttctttcggccggaaaaaccaaaagaatatttaatatctctattggaacgactgagaattgcaaaagtaacaggcgtggcgtttcctttctttatggataactctaacattgtggctatgtttgagatgatggactcctcaggcagaggcaccatatcatttgtgcagtataaagaagccctaaaaaccctgggtctatgcactgaagatgaagatttacaagatgatggacataaaataactttggataaattcaaggaggaagtgaacaagaggatgaaggaaatatgatgtatacatccagcttctctacaagcatttgccagaaaattttaaataaggagaaacaaagctgctgctccaactgaagtaaatggtctcgtaacgtcagcagcaacgggcaagccgaactggacagggacatcactgcctgctctgactgagatggcaaggacaaccatctggaaaaaacacatttttaccaaaaaattttcatcagtttctatttttcaagtttttaaatcattttaaatttgaggaagtgttctgtcctagggcattttggataagaaaaaatatacagcctaacattaaaagctctatcagaaaa

SEQ ID NO: 129137 - DNA, 3095 bp, Homo sapiens
  Payload ID: 5263
  Gene Symbol: EFCAB11
  Gene Name: EF-hand calcium binding domain 11
  Uniprot ID: Q9BUY7
  ENST ID: ENST00000316738
  CDS Start-End: 30-521
gttgctggggctcggttgttgtagtcgcgatgttcttctccgaggccagagccaggtcgcggacgtgggaagccagtccctcggaacacaggaagtgggtggaagtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagggaagtagatcgagattcagatggtcacgtcagctttagagactttgaatatgccctgaactatggacagaaggaagcctaactattgtgaactacttttggtaactctggggagatcaatagattgtaatgtcagcagactcgactctactaatgatgtcatgctacagacttgtgattaaacatttaaaaatttttaatttttgtgggtacatagtaggtgcatatgtatacatacacacacatatatgggttacgggagatattttggcacaggcatgcaataagtaattgactaaatttttaatcataatttttggatgctgatgatagacttgcatctcagaatcctagagatggttgctgccgggggtctccttctgtgtggccagcagccctgagtcaggccgccattgctagagctggggctagggatggcactggtggtcctcctcctcctcactcttcttgccccctaccctctccacactgcaggccacggtgctctactcactcacttcattgtcctcaccatcccaccctgaatctcatcatctcctaatatctgcagaggggcagacttttcctgccaatggtgccagtttccttcatttgctcaacattggttgaacaaataatagcacctacacatacagaatacttactatgttccaagcaatcagccaggccttgggaagcataggcttaagacttctctaagataggctcatgcctacaatcccagcactttgggaggccaaagcaggaggatcacttgagcctaggaattggagactagcctgggcaacataccgagaccccatccctaccaaaaaattaataataaaaaattatctggatttagtggtgtgtacctgtagtcccagctacttgggaggctgaggtggaaggatcatttgagcccaggggtttgaagcttcagtgagccatgattgcactgtcgcactccagcctggatgatagagcaagaccctgtctctaaaaaaacactttcaattaaaaaaaaacatataaagacttctctaagataatgtccctgagtccaaatcatcactgtaaagtggtcccagggcactgtctgtgcaagacaaagaaatcggcttgggctaacatgagcaagccctctcgggctatatacagaggaagaacagggtgatgagggtactgggggcaagagacatgtttgcagaaccctttaggatggtctaggcttgggagtctcactgtggagaagcaagccttgagctgctcagctgccctctgctccataccccctggtttctagcagtcacgtcctgcacccagacacttagccatgtgtgttcacgttccccatgccttgcctgtcctgctgggctccagtaactgctatactggagcaagaacagcaatgctggacactcagcatttagtgaaggtaattccaaaatactggtatcagtactcttatttataagtgtacggaatgcataacatgaacattagtcaaagaacttttaatataattcactttttaagtgttaaaatttaaaggtcaagtaaaattgtaaatttgtaatatggaaacattaagcgtcattatcatacaaattattagcagataaccttaataaaaataaacgtttgcgggttttttttgagacagagtctcactttgtcacctaagctggagtacagtgcgcgatctcggctcactgcaacttccgcctcctgggatcaagtgattctcctgccttagcctcctgagtatctgggtttacaggtgtgtaccgccacacccggctaatttttagtagagaaggggtttcaccatgttggccaggctggtcttgaactcctgacctcaagtgatccgtctgcctcggcctcccaaagtgctgggattacaggcgtgagccaccatgcctggccaataaaaataaagttttaaactgtcaaataagaggagcctaacaagatgtgacaactaaatgtcatttggtatcctggatgagatcacggaataaaaaataaacattggccggacacagtgactcagcctgtaatcccagcacttcgggaggccgaggcgggtggatcacgaggtcgggagatcgagaccatcctggctaacacggtgaaaccccgtctctactaaaaatacaaaaaacaaaaaaagattagctgggcgtggtggcaggtgcctgtagtcccagctgctcgggaggctgaggcaggagaatagcatgaacctgggaggcagagcttgcagtgagctgaaatggtgccactgcactccagtctgggcaacagagcgagactccctctcaaaaaaaaaaaaaaaaaaaaaaaaaaagacattaagtagaaacaaatcaagcatggactttagctaataataatgtatcactattggttcattaattgtaacaaatgtatcctactcatatataatgttaatagtaggggaaactgggtgaggtatatgggaaccctctactattttcacaatttttctataaatctaaaactattctaaaattaaaaattcatttaaaaaataaagtcttattcaaaacctgttaaactaaactttatctaaaatgaagaaaacattgaaaatcaagtaaaaataaaatcttatttcaaatacaaa

SEQ ID NO: 129138 - DNA, 1870 bp, Homo sapiens
  Payload ID: 5263
  Gene Symbol: EFCAB11
  Gene Name: EF-hand calcium binding domain 11
  Uniprot ID: Q9BUY7
  ENST ID: ENST00000538485
  CDS Start-End: 91-519
gcggtgggcgtggccgcggtaggctgccagccaggctgggaaagcggtggtagctggttgggttgctggggctcggttgttgtagtcgcgatgttcttctccgaggccagagccaggtcgcggacgtgggaagccagtccctcggaacacaggaagtgggtggaagtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagaggcattttcagtgcatgatttaacttcggctgtcatcaggaagctgacttaaagttctttcttgactttgcctgccatcaacaccctgtggtatttctggctggcatttttctctgcatggatatgtttacttctccatgcctaggaaccttctccatctcattgtaagcactgctatttgtacattcccaccacctgtcagttggcaaaaagctctgggaagctgcttttgcttcccagtcatgagatgaaatgtgaatgtgcataaggtccatgccctgacccagcgtccaagatcctgagtgcacaggcagattgccacatgatgatgtaaagtggcaatatcgaggcaccaaatgctcccatcatgactggagacgtttaaagttatatcctgatatttttggtgtaagaatccctttcttcatattacacaagggaaggtcaaaggacataggacatctaactctccttttttgaatattagaaattgggtgaaaatgagaatgtcattgcttgttgaataagatattttcaaaatcagagtattagtgggggctgggtcttaggaatgcaattgtaaaagggagtgatggatattcccttggcagaaaaattatatagatgttatatcacagccattataggggtaaggactgtcaccagcttgggtaaaacaaataggctcttctgttatgctgattggaagagtcttacagagctgagggcctaaaggaaagtgatttcagagaacatttactttttcaagtcatttgcgtctcttttgaaatgttatttctcactgtaatttttagcttcccataattcctttctgccagcagccaacttgtggagtatcattttcctggtccatctctaacaagagaaaatttccagtcattattttgtgcttcagaatgattctgtgtatgatcatgcaacttcagtaagatcacagttattaaaatgagtacctaatttagtgactatgactattggtctttgagtatctgcctgcttccaggtatagaaacatccataaaaacacctacaaatcatatttcattctttgtagccatacatagataacagtcatcagctataccttctgtgtgaatggcatgaccgaagaagtagacttcttgaggtcccaacttttatttcatgaaattttgtgtcttctctggaatggaaatgctttagtttttatttcaatggttttgtttcaaaattatattgtcagagattcccttttctgattgtcctgttgcacatgcttataagatggggagtatgaatgtgtgtaagcttttcaagctgacctcagaatttcctctctgagggacttctagggattttcacatgtgat

SEQ ID NO: 129139 - DNA, 1856 bp, Homo sapiens
  Payload ID: 5263
  Gene Symbol: EFCAB11
  Gene Name: EF-hand calcium binding domain 11
  Uniprot ID: Q9BUY7
  ENST ID: ENST00000556005
  CDS Start-End: 167-523
tcccgtgtctgggtctcactctgccgggtgtgcagataagacctgggctgcctgtccaaagggtcgtggttaatgactgatcctggagctgcagggctcctggctccccgtccaggactacggctacctccaagttccatctcctttctctctatatagtctattaatggtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagaggcattttcagtgcatgatttaacttcggctgtcatcaggaagctgacttaaagttctttcttgactttgcctgccatcaacaccctgtggtatttctggctggcatttttctctgcatggatatgtttacttctccatgcctaggaaccttctccatctcattgtaagcactgctatttgtacattcccaccacctgtcagttggcaaaaagctctgggaagctgcttttgcttcccagtcatgagatgaaatgtgaatgtgcataaggtccatgccctgacccagcgtccaagatcctgagtgcacaggcagattgccacatgatgatgtaaagtggcaatatcgaggcaccaaatgctcccatcatgactggagacgtttaaagttatatcctgatatttttggtgtaagaatccctttcttcatattacacaagggaaggtcaaaggacataggacatctaactctccttttttgaatattagaaattgggtgaaaatgagaatgtcattgcttgttgaataagatattttcaaaatcagagtattagtgggggctgggtcttaggaatgcaattgtaaaagggagtgatggatattcccttggcagaaaaattatatagatgttatatcacagccattataggggtaaggactgtcaccagcttgggtaaaacaaataggctcttctgttatgctgattggaagagtcttacagagctgagggcctaaaggaaagtgatttcagagaacatttactttttcaagtcatttgcgtctcttttgaaatgttatttctcactgtaatttttagcttcccataattcctttctgccagcagccaacttgtggagtatcattttcctggtccatctctaacaagagaaaatttccagtcattattttgtgcttcagaatgattctgtgtatgatcatgcaacttcagtaagatcacagttattaaaatgagtacctaatttagtgactatgactattggtctttgagtatctgcctgcttccaggtatagaaacatccataaaaacacctacaaatcatatttcattctttgtagccatacatagataacagtcatcagctataccttctgtgtgaatggcatgaccgaagaagtagacttcttgaggtcccaacttttatttcatgaaattttgtgtcttctctggaatggaaatgctttagtttttatttcaatggttttgtttcaaaattatattgtcagagattcccttttctgattgtcctgttgcacatgcttataagatggggagtatgaatgtgtgtaagcttttcaagctgacctcagaatttcctctctgagggacttcta

SEQ ID NO: 129140 - DNA, 2716 bp, Homo sapiens
  Payload ID: 5263
  Gene Symbol: EFCAB11
  Gene Name: EF-hand calcium binding domain 11
  Uniprot ID: Q9BUY7
  ENST ID: ENST00000555872
  CDS Start-End: 201-620
ggacttcagcttggcctgggcctctcgcttcctctcccgtgtctgggtctcactctgccgggtgtgcagataagacctgggctgcctgtccaaagggtcgtggttaatgactgatcctggagctgcagggctcctggctccccgtccaggactacggctacctccaagttccatctcctttctctctatatagtctattaatggtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagggaagtagatcgagattcagatggtcacgtcagctttagagactttgaatatgccctgaactatggacagaaggaagcctaactattgtgaactacttttggtaactctggggagatcaatagattgtaatgtcagcagactcgactctactaatgatgtcatgctacagacttgtgattaaacatttaaaaatttttaatttttgtgggtacatagtaggtgcatatgtatacatacacacacatatatgggttacgggagatattttggcacaggcatgcaataagtaattgactaaatttttaatcataatttttggatgctgatgatagacttgcatctcagaatcctagagatggttgctgccgggggtctccttctgtgtggccagcagccctgagtcaggccgccattgctagagctggggctagggatggcactggtggtcctcctcctcctcactcttcttgccccctaccctctccacactgcaggccacggtgctctactcactcacttcattgtcctcaccatcccaccctgaatctcatcatctcctaatatctgcagaggggcagacttttcctgccaatggtgccagtttccttcatttgctcaacattggttgaacaaataatagcacctacacatacagaatacttactatgttccaagcaatcagccaggccttgggaagcataggcttaagacttctctaagataggctcatgcctacaatcccagcactttgggaggccaaagcaggaggatcacttgagcctaggaattggagactagcctgggcaacataccgagaccccatccctaccaaaaaattaataataaaaaattatctggatttagtggtgtgtacctgtagtcccagctacttgggaggctgaggtggaaggatcatttgagcccaggggtttgaagcttcagtgagccatgattgcactgtcgcactccagcctggatgatagagcaagaccctgtctctaaaaaaacactttcaattaaaaaaaaacatataaagacttctctaagataatgtccctgagtccaaatcatcactgtaaagtggtcccagggcactgtctgtgcaagacaaagaaatcggcttgggctaacatgagcaagccctctcgggctatatacagaggaagaacagggtgatgagggtactgggggcaagagacatgtttgcagaaccctttaggatggtctaggcttgggagtctcactgtggagaagcaagccttgagctgctcagctgccctctgctccataccccctggtttctagcagtcacgtcctgcacccagacacttagccatgtgtgttcacgttccccatgccttgcctgtcctgctgggctccagtaactgctatactggagcaagaacagcaatgctggacactcagcatttagtgaaggtaattccaaaatactggtatcagtactcttatttataagtgtacggaatgcataacatgaacattagtcaaagaacttttaatataattcactttttaagtgttaaaatttaaaggtcaagtaaaattgtaaatttgtaatatggaaacattaagcgtcattatcatacaaattattagcagataaccttaataaaaataaacgtttgcgggttttttttgagacagagtctcactttgtcacctaagctggagtacagtgcgcgatctcggctcactgcaacttccgcctcctgggatcaagtgattctcctgccttagcctcctgagtatctgggtttacaggtgtgtaccgccacacccggctaatttttagtagagaaggggtttcaccatgttggccaggctggtcttgaactcctgacctcaagtgatccgtctgcctcggcctcccaaagtgctgggattacaggcgtgagccaccatgcctggccaataaaaataaagttttaaactgtcaaataagaggagcctaacaagatgtgacaactaaatgtcatttggtatcctggatgagatcacggaataaaaaataaacattggccggacacagtgactcagcctgtaatcccagcacttcgggaggccgaggcgggtggatcacgaggtcgggagatcgagaccatcctggctaacacggtgaaaccccgtctctactaaaaatacaaaaaacaaaaaaa

SEQ ID NO: 129141 - DNA, 568 bp, Homo sapiens
  Payload ID: 5263
  Gene Symbol: EFCAB11
  Gene Name: EF-hand calcium binding domain 11
  Uniprot ID: Q9BUY7
  ENST ID: ENST00000556609
  CDS Start-End: 115-462
gcgcggtgaagttcggcttcctgagccgcggtgggcgtggccgcggtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagggaagtagatcgagattcagatggtcacgtcagctttagagactttgaatatgccctgaactatggacagaaggaagcctaactattgtgaactacttttggtaactctggggagatcaatagattgtaatgtcagcagactcgactctactaatgatgtcatgctacagacttgtgattaaacattt

SEQ ID NO: 129142 - DNA, 2326 bp, Homo sapiens
  Payload ID: 5263
  Gene Symbol: EFCAB11
  Gene Name: EF-hand calcium binding domain 11
  Uniprot ID: Q9BUY7
  ENST ID: ENST00000556639
  CDS Start-End: 71-256
aggctgccagccaggctgggaaagcggtggtagctggttgggttgctggggctcggttgttgtagtcgcgatgttcttctccgaggccagagccaggtcgcggacgtgggaagccagtccctcggaacacaggaagtgggtggaagtatttaaagcatgtgatgaagatcacaaaggatatctcagcagagaggactttaaaactgctgttgtaatgctgtttgggtacaagccctccaagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagaggcctaaggattttcagcaagtgtttactctgccatattgaccagaagtctaaaaacccctcctctggcctcttagcagctgactccatcattcaggcacacccctcacctgtgcagattctcagatgtacattaataatgagctagaagggagaggttttatttgggattcatcaatttcctggaggttcatgtggaacatctatggcacaggggagtactgacgtctggtccctagccctgctccccatggtgaagagccttacacactgtgtggacacaccgcccccaacatccatgcttaatccacatccccttcaaacaaccactctgggcagaccctcaggaagaggcctgcaaagggaaaactcttgtcggtccagagaagaaagaattgccaaaattaaataaaaagtcaagattccattacctgatgatttgtgtatttcacgttgtttgcaacaaacctggaagtcatcccaagttcctttctttttcttaccctccacatccaagctgtcaacaaatctcgactctgaccacctctcagcacctccactgtgtcacccagtgcaaacctccaccaccatctcagcctcttacccagctccaggattctgcctttgcccccatcaatctacttcaggtctcttctccacccaataaataagtccagcaatgatccttgtaaaatgtacatcaggaggggccttctcatctcacctatgataggtatggagttttttcttttttccatttcacctgtgatgtatgtttgtgacctccaatatgtaaccacttactatgttgcttttaaaatgatttttaaaggtttgtttacaaccatagccactatttgcaattatgagtgtatagcactaagcatgagaactagatctgtgaaattttttgccagtttcattaggtgacctctgtaagcatcaaaacctggcattgattgaggttgtttcaggctcaactagtactgttcaaaataaagtaactgaaagcaagtctggtggtagaaggtactttataagctaactaatgcttttcaaagggatatatattgaaggaaaggctcgttttatattacatcctataaggcagtgcttcttaaactctctgtggaaaagaaccactttttataaatttccagtctgttgcaaaccgatactttgtaaaaattaataaaagtgaattactagaaaaatgaaatttttgaaaaagacatataaaataaaagttgtaatttttagcaaacaggaagttatattgcaaaaattactggggtataggaaaaaagatacaaaaattgttcgtgtttgttcattgaaagtatgcgtgtaagcaattaataggctattgcacttgtaagttttcttcattttaagggaaaatggaattcccatattaaatgtctatttgtacactttgaacacaatgtggataaatatttaaagtttttaatgtgacaaatgggattgcttcctacttgatactttacctaatctaggtaaaattgccaataaggctacttgtagggaataaggtatatctaaataatttctacgctttattttaataatgatacaaaagaaaccagtctcacaatggaatggagggagagattttagagcaattttcagtgagctcagtttattcattttaaaattttatctaagatggagccagagccactatgctttcaaagtcttccaatccctcaacagacctgagtgccagcaatatatcctgtaaattataattaaatataattatcttttggtgaaataaatggatcctagatccatggattttttagacatagatcttcttttgatggaaa

SEQ ID NO: 129143 - DNA, 698 bp, Homo sapiens
  Payload ID: 5263
  Gene Symbol: EFCAB11
  Gene Name: EF-hand calcium binding domain 11
  ENST ID: ENST00000557685
  CDS Start-End: 1-354
gtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagaggcattttcagtgcatgatttaacttcggctgtcatcaggaagctgacttaaagttctttcttgactttgcctgccatcaacaccctgtggtatttctggctggcatttttctctgcatggatatgtttacttctccatgcctaggaaccttctccatctcattggaagtagatcgagattcagatggtcacgtcagctttagagactttgaatatgccctgaactatggacagaaggaagcctaactattgtgaactacttttggtaactctggggagatcaatagattgtaatgtcagcagactcgactctactaatgatgtcatgctacagacttgtgattaaacatttaaaaattttt

SEQ ID NO: 129144 - DNA, 2153 bp, Homo sapiens
  Payload ID: 5264
  Gene Symbol: EFCAB12
  Gene Name: EF-hand calcium binding domain 12
  Uniprot ID: Q6NXP0
  ENST ID: ENST00000326085
  CDS Start-End: 164-1882
gtccgtagccacggcaacaggttgcttctgcagtctgagctgagcgcctttcgcacgacttggagttacggtttatctgataccccggtacccctacgcaagcaagcccacatcgacacacattcacacacgcccttcagcaccccctcccagcaccacgaccatggacgacgactatgaagcgtaccacagtctgttcttgtcgctgctcggactctgcccgtctaagactcccatcaatgaaaatgctcccgtctttgatcctgaaccggtcattgcccactgcttcaagcagttccagcagaaggacttccgcctgcctcagacccgccggcgaatcatcatggtgcctcgcaaggaggatcagacaccccttaatcctgcatcccaacctcaggctcccccaaagcccatccccagcttcaaagttctggaagctagagatatccaagagcagccagaggacaggaagacctggctgagccagaggtcgaagctgcggcaggagctagagtcctttggtgatgtaaagaggtggctggagaacaagcccagcatcacgccttcagaggccaaggtcttacacatgatccacgaggagcagagtgcccagccaaatgcctcccaggcaactaccaggaccaccaggaagaaagcccccaggctctcccggctgtcccgccagatggtgccccagctccagctgcccgagccccctgccctgtcggtcatgtactcctacctgcatagccgcaagatcaagatcctggagatatttcacaaggtgggccagggtgagaaccagagaatcaccagggaggagttcatcgcggctgtaaaggcagtcggagtccctctgaagaaccaagaggtggaggatatagtgatctacctcagctctcttgggaagcacaacaccatcaccatggatatcctggccaatacctacaagcagtggtctatggctcagcaaaggagcagcctggccactgcaagggagcattatatcttggccaagcacagagattccctgaagggtccgctcaagaagcaggaggtggattcagccccacagcttcccaaagtggacctactgacggtgcctgcagtcgacacgcagatggagacgcggcccatgaccctggaggagatggaggaagtgggcaagcggtaccgcgagcggcagcgacagcacaagctcacgatcccctccatccagtacacggagcaatgtcacctggtgcgctgtgggaatcggcactttgatgagcactgcctcccgtccaccatccacggggatatgagggagctcattgactcggcccgcaggcacaactttctggtctacctgcaatgctggaagctctgtaagtcctatggcctcccgctgacagaggacatcctcatgaaagccttgctgtacccaggagacaagatcattttccagatggacaaagtgtgccccatccggcagccgggaggctactactctgactggaaggtcttttctccgaatctggctctgctccggtcccagggccctggcaagtctaagaggactgacaagaaaacgccaaagaaaagcaagaaaatgcgctttaaggagtttgaggaatttaccaggaagctgaaggtgaagaggtccagtggtctgcagcaaacacaccccaattccttctggccgggtcatcttctggataagctgcagctctacctgcccactgtggccacagaccggagcctggcgctcttcagttgtgttcaacaccagccccatgtctacccagccacctaccaccctgaccactggtggccccttaggaacaagaactacatgacccacgcccattatgatgccgccaaggtgtactacatcaactagagctagccaggtgttgccggacccagccttcctgggccaggggccagtgcagccagcggcccagagcccagacacaagaggagtgtcaaagagtcaaactaaagaaatcctttcaaagagggatggaccgggggccagttccctctggactcaaagtgtccagtgtctcagagggtagatgtgtccaaggaatgacgtgcagtttttgactatttccctcccctgacctctgccctttctacataaagcaggttggagtttttctcatttc

SEQ ID NO: 129145 - DNA, 2154 bp, Homo sapiens
  Payload ID: 5264
  Gene Symbol: EFCAB12
  Gene Name: EF-hand calcium binding domain 12
  Uniprot ID: Q6NXP0
  ENST ID: ENST00000505956
  CDS Start-End: 164-1882
gtccgtagccacggcaacaggttgcttctgcagtctgagctgagcgcctttcgcacgacttggagttacggtttatctgataccccggtacccctacgcaagcaagcccacatcgacacacattcacacacgcccttcagcaccccctcccagcaccacgaccatggacgacgactatgaagcgtaccacagtctgttcttgtcgctgctcggactctgcccgtctaagactcccatcaatgaaaatgctcccgtctttgatcctgaaccggtcattgcccactgcttcaagcagttccagcagaaggacttccgcctgcctcagacccgccggcgaatcatcatggtgcctcgcaaggaggatcagacaccccttaatcctgcatcccaacctcaggctcccccaaagcccatccccagcttcaaagttctggaagctagagatatccaagagcagccagaggacaggaagacctggctgagccagaggtcgaagctgcggcaggagctagagtcctttggtgatgtaaagaggtggctggagaacaagcccagcatcacgccttcagaggccaaggtcttacacatgatccacgaggagcagagtgcccagccaaatgcctcccaggcaactaccaggaccaccaggaagaaagcccccaggctctcccggctgtcccgccagatggtgccccagctccagctgcccgagccccctgccctgtcggtcatgtactcctacctgcatagccgcaagatcaagatcctggagatatttcacaaggtgggccagggtgagaaccagagaatcaccagggaggagttcatcgcggctgtaaaggcagtcggagtccctctgaagaaccaagaggtggaggatatagtgatctacctcagctctcttgggaagcacaacaccatcaccatggatatcctggccaatacctacaagcagtggtctatggctcagcaaaggagcagcctggccactgcaagggagcattatatcttggccaagcacagagattccctgaagggtccgctcaagaagcaggaggtggattcagccccacagcttcccaaagtggacctactgacggtgcctgcagtcgacacgcagatggagacgcggcccatgaccctggaggagatggaggaagtgggcaagcggtaccgcgagcggcagcgacagcacaagctcacgatcccctccatccagtacacggagcaatgtcacctggtgcgctgtgggaatcggcactttgatgagcactgcctcccgtccaccatccacggggatatgagggagctcattgactcggcccgcaggcacaactttctggtctacctgcaatgctggaagctctgtaagtcctatggcctcccgctgacagaggacatcctcatgaaagccttgctgtacccaggagacaagatcattttccagatggacaaagtgtgccccatccggcagccgggaggctactactctgactggaaggtcttttctccgaatctggctctgctccggtcccagggccctggcaagtctaagaggactgacaagaaaacgccaaagaaaagcaagaaaatgcgctttaaggagtttgaggaatttaccaggaagctgaaggtgaagaggtccagtggtctgcagcaaacacaccccaattccttctggccgggtcatcttctggataagctgcagctctacctgcccactgtggccacagaccggagcctggcgctcttcagttgtgttcaacaccagccccatgtctacccagccacctaccaccctgaccactggtggccccttaggaacaagaactacatgacccacgcccattatgatgccgccaaggtgtactacatcaactagagctagccaggtgttgccggacccagccttcctgggccaggggccagtgcagccagcggcccagagcccagacacaagaggagtgtcaaagagtcaaactaaagaaatcctttcaaagagggatggaccgggggccagttccctctggactcaaagtgtccagtgtctcagagggtagatgtgtccaaggaatgacgtgcagtttttgactatttccctcccctgacctctgccctttctacataaagcaggttggagtttttctcatttca

SEQ ID NO: 129146 - DNA, 618 bp, Homo sapiens
  Payload ID: 5264
  Gene Symbol: EFCAB12
  Gene Name: EF-hand calcium binding domain 12
  ENST ID: ENST00000503957
  CDS Start-End: 143-618
ctgagctgagcgcctttcgcacgacttggagttacggtttatctgataccccggtacccctacgcaagcaagcccacatcgacacacattcacacacgcccttcagcaccccctcccagcaccacgaccatggacgacgactatgaagcgtaccacagtctgttcttgtcgctgctcgaagaaagcccccaggctctcccggctgtcccgccagatggtgccccagctccagctgcccgagccccctgccctgtcggtcatgtactcctacctgcatagccgcaagatcaagatcctggagatatttcacaaggtgggccagggtgagaaccagagaatcaccagggaggagttcatcgcggctgtaaaggcagtcggagtccctctgaagaaccaagaggtggaggatatagtgatctacctcagctctcttgggaagcacaacaccatcaccatggatatcctggccaatacctacaagcagtggtctatggctcagcaaaggagcagcctggccactgcaagggagcattatatcttggccaagcacagagattccctgaagggtccgctcaagaagcaggaggtggattcagccccacagcttcccaaagtgga

SEQ ID NO: 129147 - DNA, 3931 bp, Homo sapiens
  Payload ID: 5265
  Gene Symbol: EFCAB13
  Gene Name: EF-hand calcium binding domain 13
  Uniprot ID: Q8IY85
  ENST ID: ENST00000331493
  CDS Start-End: 412-3333
agagctagagcagcgccgcccgaggggcggcaggggctgaccacagagagcgcgggggcctccagccgagaggaagggagggcagctcgggccgaagtcgttggcttcgtaagagcagggtctatgggaagcctcctcagcgtgggttcttggaagaggtggagtttggagaggcttatgcggtacctgattcatccagcaaattaagacctgccaactttttgataatctcgtcaataaattacagaacaattgttcctttcaagatttattcaaaacgtgtcaactctgcttaattaagcactttgatgatttaagaaatcttggaaatccttttgtactattgctcattcatacttgttcatcaaagcctggagtccttaaggacagaatttacctctaaacagaaagatggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaattactcgggaaaaggaaatgctgtctaacctctacatgacattatatgatgaagtaacccatggatatttacactcaaaagaattaagtgcacttcataaagcctgtaaaatttttagtaaaattcgaagtggtaagatttatgtgaatgatcttccagtgatcctttgcatcttgagaatttctataagtgatttagaaatgcgacaggcactaaagactgttgatattgatgcattccaggatgccttgaagattttctgtaggataaaaggtggtcgagtttcaactgatgacgtgtttgctgttttggatagcatgggtatccctataaaccgtgaaattttagaagaagtgacaaaacatacctatattgacagtaaccacatggtggatattggggatattatatttactttgaatgagctacaggaacagtatgaggatgtttcaattacagaaggatcacctttgaatgaaattacttcagacagaaagttatcaagtgtagcaggatgctatctaaaatataagaagaaaaatagtttgtcttccaaactccctgaaccttcaatatccaaaaagttaaataaaaaaagcaaccaatattatagcaaaattatggagaatgatgaccttgaatctaaaagaccaaaaaatacttggcaaataagaaaatttctgggtggggttggcagcagtaatgtaggagtccaagaaccatattcaaagaatggcataaactttaaaaaacattcagagaagggtgaaattcatgactcaaagtctaaaccacaaagcttgaagagtagtacaagcctcagtaagtctctggataaaagtgatatttctagtatcccaaaacttcagaagccagctgtaagaaagcattccagtctccaaaaacaggtttcgtctacggaaaaaactgcaattagtactctggaaaacttctgtgaagctatcagtaaacttcaagaaaattacattgcagcagaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgaaggtgacaaagtacaatttgaagaatttgcaaaagtagtaaggaatatgcgtgatgctgccaggttagaagagttacaggaagttgtcttagctgctgatttgctggaaggtgacatgatagctgggaagaacttggaagactttctaagaaatgttgggattaagtcacctaaagaagaggtagagaaaattcttcaatcagattttgtttctgaagataacatggtgaacattaaagactgtatgagggctttgagggacacccagaaattttccaattatattgatttcaggaaagaggcttcaaatctaaaattaccaaaggtaaacgagattaaagaagctgctaacatcttgtcacatgtcgataatggcaagattggtatacctgatttggagcatgccttgaaatgtttgaatgttaatttaactgaggaggacttcaatgaagcccttaactgttgtaacgtcagtgataatatggaggtggatttaaaagatttcttaatgaaaatgaaagaaagtccacatttccaaaagtccaaggctacacagatactcttagctactacccaaattctccagaatgatctagttgatgtctctgacctcaagacattattgatggacaaggaccttcatacagctaatgctatacttactgtaatgttaagacatgtacctgaacatgaaagtggcaaggttagcattcaagaatttatgactaaattatccgatatattgacaattcctaaagctgcaggtaagttttatttaatatgtacttattgcccagatctagaaaggcaagcagtggtttacatgttaaaaacaatacaggattcgatagttaaagcacaggtaagtaagaagcaatacaatatgaatataaaacaacacaagattagtttacataacttctgtttgaattctaaggcaaatattgctaagcttaacccaaactcaaaattttaggtagtcttacttgatagtgctagaaaattactagattatatattattcagtatgcatatttgacttctgaaattattagaaaataatttttaaaacttttgacaaatccagtagaatttttatcactatctgttatgttctcatgtatcttcagcgactctcttgatcacactttttaaacattcatgctttttgaggtataatgtacatatggcaaaattcactctttttaggtatacagttctttggattcttaaaaataatgtaatgtaacccttactatacacaacatatagactatattatcccccagaagtctcttatgcccttttggtaatccatttcttcctctaccctgagcccctggcaactactgattcattctttgtccctctagttttgccttttgtggaatatcatgtaaatgattaaatatgaagtggtttgagtttggcagtcattgcatgcatataccttgaatttactttgtttatactctcatttatactaccaaccctccctagaaaaaatggattctgattggttctggttgcagtattacaaattccaaataaagctttatttgaggacccccaaa

SEQ ID NO: 129148 - DNA, 573 bp, Homo sapiens
  Payload ID: 5265
  Gene Symbol: EFCAB13
  Gene Name: EF-hand calcium binding domain 13
  ENST ID: ENST00000523285
  CDS Start-End: 463-573
aggacggaccgaaggtaagattgaagtggggtcagaccatggcgggacagcgcaccggagaatgaacagcgattagggaagagtggcgagcgggtggcaaggacggagggcggaatcccggccggggctgcgggaggaaagcgcacggacaggagccccaccgctcgaatgcagcgcccggcggctggcctcgtgaggtcacaggcccttacgagtttggagaggcttatgcggtacctgattcatccagcaaattaagacctgccaactttttgataatctcgtcaataaattacagaacaattgttcctttcaagatttattcaaaacgtgtcaactctgcttaattaagcactttgatgatttaagaaatcttggaaatccttttgtactattgctcattcatacttgttcatcaaagcctggagtccttaaggacagaatttacctctaaacagaaagatggaaactaaagtacatttattctgccaggcagaggaaaatattgacttattagatgatggctctaattcttttgcaactgacttgtcatcaggaactattaaccacaag

SEQ ID NO: 129149 - DNA, 651 bp, Homo sapiens
  Payload ID: 5265
  Gene Symbol: EFCAB13
  Gene Name: EF-hand calcium binding domain 13
  ENST ID: ENST00000523842
  CDS Start-End: 1-603
gaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgataatatggaggtggatttaaaagatttcttaatgaaaatgaaagaaagtccacatttccaaaagtccaagggtaagtgaatacttcttgttcaagagaatggctagaaaataaatatttaaaaatga

SEQ ID NO: 129150 - DNA, 3466 bp, Homo sapiens
  Payload ID: 5265
  Gene Symbol: EFCAB13
  Gene Name: EF-hand calcium binding domain 13
  Uniprot ID: Q8IY85
  ENST ID: ENST00000517484
  CDS Start-End: 368-2722
agagagcgcgggggcctccagccgagaggaagggagggcagctcgggccgaagtcgttggcttcgtaagagcagggtctatgggaagcctcctcagcgtgggttcttggaagaggtggagtttggagaggcttatgcggtacctgattcatccagcaaattaagacctgccaactttttgataatctcgtcaataaattacagaacaattgttcctttcaagatttattcaaaacgtgtcaactctgcttaattaagcactttgatgatttaagaaatcttggaaatccttttgtactattgctcattcatacttgttcatcaaagcctggagtccttaaggacagaatttacctctaaacagaaagatggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaattactcgggaaaaggaaatgctgtctaacctctacatgacattatatgatgaagtaacccatggatatttacactcaaaagaattaagtggtaaccacatggtggatattggggatattatatttactttgaatgagctacaggaacagtatgaggatgtttcaattacagaaggatcacctttgaatgaaattacttcagacagaaagttatcaagtgtagcaggatgctatctaaaatataagaagaaaaatagtttgtcttccaaactccctgaaccttcaatatccaaaaagttaaataaaaaaagcaaccaatattatagcaaaattatggagaatgatgaccttgaatctaaaagaccaaaaaatacttggcaaataagaaaatttctgggtggggttggcagcagtaatgtaggagtccaagaaccatattcaaagaatggcataaactttaaaaaacattcagagaagggtgaaattcatgactcaaagtctaaaccacaaagcttgaagagtagtacaagcctcagtaagtctctggataaaagtgatatttctagtatcccaaaacttcagaagccagctgtaagaaagcattccagtctccaaaaacaggtttcgtctacggaaaaaactgcaattagtactctggaaaacttctgtgaagctatcagtaaacttcaagaaaattacattgcagcagaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgaaggtgacaaagtacaatttgaagaatttgcaaaagtagtaaggaatatgcgtgatgctgccaggttagaagagttacaggaagttgtcttagctgctgatttgctggaaggtgacatgatagctgggaagaacttggaagactttctaagaaatgttgggattaagtcacctaaagaagaggtagagaaaattcttcaatcagattttgtttctgaagataacatggtgaacattaaagactgtatgagggctttgagggacacccagaaattttccaattatattgatttcaggaaagaggcttcaaatctaaaattaccaaaggtaaacgagattaaagaagctgctaacatcttgtcacatgtcgataatggcaagattggtatacctgatttggagcatgccttgaaatgtttgaatgttaatttaactgaggaggacttcaatgaagcccttaactgttgtaacgtcagtgataatatggaggtggatttaaaagatttcttaatgaaaatgaaagaaagtccacatttccaaaagtccaaggctacacagatactcttagctactacccaaattctccagaatgatctagttgatgtctctgacctcaagacattattgatggacaaggaccttcatacagctaatgctatacttactgtaatgttaagacatgtacctgaacatggttagtagtttcaatgcgtctatcttataaggaccatcctctaccacaggggtggaaggtctatgggtaggacatgcagggatggagggtatcctgtggaagctgaggtgggatgactgctggacactggtactgcccctacaggtgtgccaaccctgagcttcatggggccaaacaaatggggaagtcagagctcatcttatccctgtgtgagtccactgacagtacctaggaggtgagattattttgtgaactgactgacatgcacagtggtcaatcagaatgccatccatagagtaaaacagggtcctggaggcccttttggtttttggaaggtaaattatgatgatatccagggataccagggggtgttgcacatagtggtggctcagggcagcagatatttataaatataaaaaataattttactattttaatgacaggtatagctgaatattatccatgatgggttcttaaaatgagttggggagtatttttttgttttgttttttaaaagagacttttttcttccttgaatgttgagtagaattcataggtgaagccatgtgggccaagagtttttttgtgaaaggctttggattatttatttaatgtctttaaatgaataggattaacaaggtattctattttcttgttagttttggcaagctatgtttttagaggaattcgttcattagatctgccttttcaaatgtattgaataaagttgttctctttttgacatctga

SEQ ID NO: 129151 - DNA, 553 bp, Homo sapiens
  Payload ID: 5265
  Gene Symbol: EFCAB13
  Gene Name: EF-hand calcium binding domain 13
  ENST ID: ENST00000519772
  CDS Start-End: 393-553
agagagcgcgggggcctccagccgagaggaagggagggcagctcgggccggtagtgggacccttgggggacagagaagtcgttggcttcgtaagagcagggtctatgggaagcctcctcagcgtgggttcttggaagaggtggagtttggagaggcttatgcggtacctgattcatccagcaaattaagacctgccaactttttgataatctcgtcaataaattacagaacaattgttcctttcaagatttattcaaaacgtgtcaactctgcttaattaagcactttgatgatttaagaaatcttggaaatccttttgtactattgctcattcatacttgttcatcaaagcctggagtccttaaggacagaatttacctctaaacagaaagatggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaat

SEQ ID NO: 129152 - DNA, 1477 bp, Homo sapiens
  Payload ID: 5265
  Gene Symbol: EFCAB13
  Gene Name: EF-hand calcium binding domain 13
  ENST ID: ENST00000517310
  CDS Start-End: 1165-1477
agtcagcgcggaggcggtattgagttcagccgctccccacagccccggagcccctgggcggtggcggtggccgcggcagcaccggctcgacagccgatagggtcctgggcccgctccgctcggggtggtcggtgggcggagcgtcgggctcggtcagaagtcgttggcttcgtaagagcagggtctatgggaagcctcctcagcgtgggttcttggaagaggtggagtttggagaggcttatgcggtacctgattcatccagcaaattaagacctgccaactttttgataatctcgtcaataaattacagaacaattgttcctttcaagatttattcaaaacgtgtcaactctgcttaattaagcactttgatgatttaagaaatcttggaaatccttttgtactattgctcattcatacttgttcatcaaagcctggagtccttaaggacagaatttacctctaaacagaaagatggaaactaaagtacatttattctgccagatgcctccacctttttttgctagtattgtgtcaaataagacaagttttttcaaataaaaacaaatctggacttagtaagcagagactttattcaaaataattattgcaagagaaaaaagggactattgaaattggaagaggaggaggactattgcaatggaaagaatgctgtgaccgtaagatctgtaggtgtctcaagggttgggcagaagttttcttttatagagagacgctggaaagaaccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaattactcgggaaaaggaaatgctgtctaacctctacatgacattatatgatgaagtaacccatggatatttacactcaaaagaattaagtggtaaccacatggtggatattggggatattatatttactttgaatgagctacaggaacagtatgaggatgtttcaattacagaaggatcacctttgaatgaaattacttcagacagaaagttatcaagtgtagcaggatgctatctaaaatataagaagaaaaatagtttgtcttccaaactccctgaaccttcaatatccaaaaagttaaataaaaaaagcaaccaatattatagcaaaa

SEQ ID NO: 129153 - DNA, 355 bp, Homo sapiens
  Payload ID: 5265
  Gene Symbol: EFCAB13
  Gene Name: EF-hand calcium binding domain 13
  ENST ID: ENST00000518170
  CDS Start-End: 338-355
gtattttgcccaactgcatacgataaatacataggaaaaacaaacacacagaagaaaaccaaaccaaccaaagtatctctttcaaaaggaaacgacagtctccttaaaggcaacccgagacaaatttcagcaaagccgtgggacacatggccttcgagctgctgtccattattgagtagcagaagccaagaaggatggaatgttttggaagaaaggggtcgggggtcggggtgttcaaaggacggaccgaaggaaatccttttgtactattgctcattcatacttgttcatcaaagcctggagtccttaaggacagaatttacctctaaacagaaagatggaaactaaagtacat

SEQ ID NO: 129154 - DNA, 5767 bp, Homo sapiens
  Payload ID: 5266
  Gene Symbol: EFCAB14
  Gene Name: EF-hand calcium binding domain 14
  Uniprot ID: O75071
  ENST ID: ENST00000371933
  CDS Start-End: 978-2465
cgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtcggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcttgctccggaggtccgaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactaagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 129155 - DNA, 784 bp, Homo sapiens
  Payload ID: 5266
  Gene Symbol: EFCAB14
  Gene Name: EF-hand calcium binding domain 14
  ENST ID: ENST00000487741
  CDS Start-End: 1-200
cagccacatcagaacttgacaataaaacccacagtgagaatttgaaacagatgggtgatagatctgccactctgaaaagacagtctttggatcaagtcaccaacagaacagatacagtaaaaatccaaagcataaagttctgccaccagttgactcatcaccagggagaaacagaggaaagatcaggggaaaacttgtgaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaa

SEQ ID NO: 129156 - DNA, 860 bp, Homo sapiens
  Payload ID: 5267
  Gene Symbol: EFCAB2
  Gene Name: EF-hand calcium binding domain 2
  ENST ID: ENST00000366521
  CDS Start-End: 1-664
ggccgggacaccgcggccgaggttatcgttaggcatctcccaggcgaccggctccgcagcaagatggcggacgagaaggacagggaagggcctgggatacaacagtgatgagataaggcctcggactttactgatcgaacatctaatggaaggtggaagaagagaccatcacacaatgacggtgttatggggaacacaggagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaaggtgagcctttttctcaagaggaaatggaagaaatgttgtctgctgcaattgatccagaatcaaattcaattaattacaaggactatataacaatgatggtgatagatgaaaattaaatgttctaaagataatttctgattgaaagaacaattttagaaattgcttgttcttgttaatttcacatcttatcttaggattcctatatgtgatatttaataccttgtgacataactattttaagacactttgtttttaaagatgatcgtaacactttaaaccaaatttagtatgtctagccttacagaatgataa

SEQ ID NO: 129157 - DNA, 6167 bp, Homo sapiens
  Payload ID: 5267
  Gene Symbol: EFCAB2
  Gene Name: EF-hand calcium binding domain 2
  Uniprot ID: Q5VUJ9
  ENST ID: ENST00000366522
  CDS Start-End: 142-951
gcagttaacaacaaaaatcgagcaacgccacgtcgcacaaacaggacaggagggggcgaggggtgtgtgcgcgcgcgtgctgtccccaaatggatgagaaataagggaaaggaggggttggggaccgtgtgatgaagcaacatgctaggcccgggacaagtccggctccggcctcgggtctggagggacaaggccgggggccgggtggcagacggggcctctggtcttcccccagcgcgagggtcgtggcgcgaaacggggacagggcgcgcgctcggagcctcctccccgccccgccccgcccaagggtcttcctcccccgggattcagagcggcccctcctccaggccaggctcgccgcggggcgctgagcaggccgggacaccgcggccgaggttatcgttaggcatctcccaggcgaccggctccgcagcaagatggcggacgagaaggacagggaagggcctgggatacaacagtgatgagataaggcctcggactttactgatcgaacatctaatggaaggtggaagaagagaccatcacacaatgacggtgttatggggaacacaggagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagatggagtttcgctccgtcgcccaggctgaagtgcagtggcgtgatcttggctcgttgcaacctccacctcccgggttcaagagattctcctgcctcagcctcctgagcagctgggatgacaggcacacaccaccacgcctggctaatttctgtatttttagtagagacggggtttcaccatggtctggtgacctcctggtctcgaactcctgacctcaagtgatcctcccgcctcagcctcccaaagttctgggattacaggcatgagccaccgcacccggctgcttccttaactcttgatctcctctctgtatcttgctttgtctagctgttctcttctctccatattcatccaaacatttgcttagaagtacccagaagcatggcgttgaatgtggtacaccttgaacgaagggtgaagaaacgaggcagagtgacttagtagcaagtgacagcacacagtttaaattttaatattagcccatttacaaacaacagcttatataatagtcattcacatacctcaacactcaccatcccctccccactttttttctggagacagggtttcactgtcaccccagctggaatgcaggtggcatgatcacagctcactgtagcatcgacctcctggactcaaggggtcctcgcgcctcagcctcctgagtagctgggaccacaggtgcatgccaccacgcccagctaatgtttttttttattttttgtagagacagggtctggctatgttgcttaggctggtctcaaactcctgggttcaagcgatcctgccacctcagcctcccaaagtgttaggattacagatgtgagccactgtgcccagccaacattcaccccattcaagtgtgcaattcaatggattctagtatcttcacagtgctgtgcaactatcactcctatctacttacaaagcatttccatcatcttaaaaagaatccccatgtccaatagcagttccccttcccccaccgtcatcctcgggcaaccgctaatcttcctgtgtgtctgtggatttgcctcttcagggcatttcacataaacacaatcatacaatatgtggccttctgtgtctggcttctttcatttagtgtaaggcttttgaggttcatccatgttgtaatgtatatccttagttcattcttttttgttaagctcacaaataaaaagcctcactttttatttgaggcaaggagactggctacagggattacagttccagcagtcaaaacgcaactccaagtggcactatttggaccgtaggttttgcttcattttggctggaaaagggtattcaggatgtacttctcccagccggacaagaaaaagggcaaagaaaactggaagagacgtctcgtctacacaaactgctctttggacacagcatcaacctgaccacacccgtgctggccagtctgcaggttgctgacccgccgttaagggacacaggccatactacacttgctagaaaaactgaggcaggaaaaagaggtgcaaggcactgggggaagagcaggtacctatagctttaaagctcagtgttgaaggggtaatccttgcaggaggcacagctcaccaagacacagaccctcccgttcctgttgtagctgactacagtggtcacatcaggctgctcagttgaaagtcgaagtcctccaagttttcagcagtgcgttccagcatcaccaccgaaatgatgataggaattaccaccaaattcctatgcatgggaaaccagatcagaacctgggctgcgtttttatttgtttattttttttactgtgcttggctgtgattgctttggtgctgggatcccccagacctgtcacgagagctgaggggactacaggcagtcaccaccttgcctttggattggcagccctggattaacttctcctgaggtgggtgcaggtggcactcactgtggttaaccactgtttttaagccaggtttctttttttctgtctgtcatatatatatatatatatttagagacagggtctcactctatcactcaggcctggagtgtagtggcatgatcataactcactgcagcctcgagttcctgggctcaagtgatcctcccgccttggcctcccaaagtgctgggattacaggctgagacaccacacctggtcttaagccaggtttctttaccatctcttggagatggctgcagttggagattccaaaagctttcagagcccttcatccaccagctcctccatgtggccacccatgtgacatgaagttggtgtcactaggtaccacgttgtctgtcccatccaacaggaaaaatagcctgttggccagtgaataaggtaggaatccaggtggtcccctgagggtcttctgacaggctcctttatcaggctcttctcatggtatgagcaccgcagcttgctgacagtggcaacgttctcaagcttcacagactccgtcacttggcctggaggggaattctaggtgtccagccccaggacaggcattttggcaccatgattgagcacgatatggtgagccatcctcacaggattaagaagaattctggacagaaatatagttgtaagtaagcatcagtcagcctgcactttgacccacttccttgtaaccaacagtgacgtagcactaggtaacatttgcatccccgttgttcctatagatacaatttctgaccttagaatcacaaggcttttgtttaaaatagatgggatctctgacattagaatcataagatttttgtttaagacttgcttaagatgtttttcagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttaccgtggctggccaagcctgctgtgcttcacagaccccactcaggatcacaccacttcgttccactgtttggagatgccatgtttgcttatcccttcatcagctgatgagcatttgtgctgttttcactttttggctattacgaaaatgttgctacgagcatccatgatattcgcccatttaaaaaagtgtttttcaccattactgctgtgggaaatttctccctggctctgtcctttctttgtagcccagccttcccccaggttttggctctccctctctggctcaatgtcagctccttgtctcacctcctagagcaattccactctcccacctcctgctgcggcatttccaaagcctctgcttagcaagggaccacccattctgcacctctccccttagggctgcaagcacctgcacaaacttggtggttatcctatgcctcaactcaatcaaattctctcagttttccatcagcaatctttttaagccaaagggaaggcaaggacttgatcttcacatcacatgaatcatgacacctgccttagaaggcagaagcaactgtagttggaatagcaattgtttttcaacatatgggatgatatcaaggctctttcctccccatatgtcctgccctgttagtggctggggctgagggttttcccaggaagccagattgtcctcacaagttcctcaggaccctagggcttccacagatagtaggactgttatcagaaagaagtctcgatccagacgccgagagagggttcttggatatcgcccaagaaagaattcagggggagtccatagagtgaagtgaaagcaagtttgttaagaaaacaaaggagtaaagaatggctactccataggcagagcagctccgagggctgctggttgcccatttttttttttttttctttgagatggagtctggctctgtcgcccaggctggagtgcggtggcacaatctcggctcactgcaagctccgcctcccgggttcacgccattctcctgcctcagcctcccgagtagctgggactacaggcgcccgccaccatgcccggctaattttttgtatttttagtagagatgaggtttcacatgttagccaggatggtctcgatctcctgacctcgtgatccacccgcctcggcctcccaaagtgctgggatgacaggcgtgactcgtgatccacccgcctcggcctcccaaagtgctgggattacaggcgtgagtcaccacgccgggccggttgcccatttttatgattatttcttgattatatgctaaacaagggctggattattcatgagggaaaggggtgggcaattcctggaacggagggttcctcccccttttagaccgtgtaggataacttcttgacattgccctggcatttgtaaactgtcatggcgcaggtgggagtgtctcttagcatgctaatgcattataattagcatataatgagcagtgaggtcgaccagaggccactctcatcaccattttgggtttggtgggttttggccacttctctactgcaacctgttttatcagtaaggtctttatgacctgtatcttgtggtgacctcctgtctcatcctgtgacttagaatgcctaacaggctggggacgcagcccagcagatctcagcctcattttactcagcccctcatcactctgattcaaatgcctctgacatgaccacgcagatttgagaaacaggccctcagccaaccagactctggctctacgacacacttaatactgtgaaaagaagattacgggtcatagtcacaaataccaggggtgcaaaacttcagattagaagacacttgtcagactcagaggctcatccaactccacggagatcattatcaccacaagttcttcagacaggtgtggaggttttctaagggatatttttattttctggattgcaattttgtttaggaagagatgaaagtgaggatcaactactttgaggattgtacaactttgtaaattgcacaaatatgacggcatatttatatctgcctgcatttgtgaaaacaaacttgtcaaggagcttatttctggaaagggtcaatgattctagaaaaaaaaaaaagataaatatgagacccttcagtaaaaagaaa

SEQ ID NO: 129158 - DNA, 1233 bp, Homo sapiens
  Payload ID: 5267
  Gene Symbol: EFCAB2
  Gene Name: EF-hand calcium binding domain 2
  Uniprot ID: Q5VUJ9
  ENST ID: ENST00000366523
  CDS Start-End: 266-754
gggaggcgggctgcgaatgggaagcgggaggaggaggccgggccgcgggctggttctatcacccccttgggagcccagctcttcacctagctctccggcgcttttcaaaatctgcagttaacaacaaaaatcgagcaacgccacgtcgcacaaacaggacaggagggggcgaggggccaggctcgccgcggggcgctgagcaggccgggacaccgcggccgaggttatcgttaggcatctcccaggcgaccggctccgcagcaagatggcggacgagaaggacagggaagagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaaggtgagcctttttctcaagaggaaatggaagaaatgttgtctgctgcaattgatccagaatcaaattcaattaattacaaggactatataacaatgatggtgatagatgaaaattaaatgttctaaagataatttctgattgaaagaacaattttagaaattgcttgttcttgttaatttcacatcttatcttaggattcctatatgtgatatttaataccttgtgacataactattttaagacactttgtttttaaagatgatcgtaacactttaaaccaaatttagtatgtctagccttacagaatgataaattactatttatttaaaaactattcttaaaacattttaacattagaatggattgttgtttattttctacaataaaactcaggtcaccttcgaattaattaagctgacaaaatgaaaatgacttaattacccaaggtttggcatgtaaagatcttaagagggggcagaacgaaccactcgaaaacgagtagcagtgtaatgaaggcttcttttttaaacaataacaaatgcttcatcaatctgagtgtggaaggtgatttatcaaaataaatattactaattta

SEQ ID NO: 129159 - DNA, 325 bp, Homo sapiens
  Payload ID: 5267
  Gene Symbol: EFCAB2
  Gene Name: EF-hand calcium binding domain 2
  ENST ID: ENST00000427529
  CDS Start-End: 1-158
cagaagatgtccttcttcgagcttttgaggttttagattcagctaaacgtgggtttcttactaaggacgagctgatcaagtatatgactgaagaaggtggtgtcgttatcacccccattctagagacaggtaagctaaggtggggagctgtgaagtgacttgctcaagatctcagagctcgtgagaggcagccagcatgtggatccaaacttgtgctttaaccactcagttatcttccttccatctttcatcaaatactggggcttcaagttaatcctctggtaatttcaaaagttttaatctaaataaataaccttgttcatga

SEQ ID NO: 129160 - DNA, 550 bp, Homo sapiens
  Payload ID: 5267
  Gene Symbol: EFCAB2
  Gene Name: EF-hand calcium binding domain 2
  ENST ID: ENST00000425550
  CDS Start-End: 1-383
agataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagagacaggtaagctaaggtggggagctgtgaagtgacttgctcaagatctcagagctcgtgagaggcagccagcatgtggatccaaacttgtgctttaaccactcagttatcttccttccatctttcatcaaatactggggcttcaagttaatcctctggtaatttcaaaagttttaatctaaataaataaccttgttcatga

SEQ ID NO: 129161 - DNA, 527 bp, Homo sapiens
  Payload ID: 5267
  Gene Symbol: EFCAB2
  Gene Name: EF-hand calcium binding domain 2
  Uniprot ID: Q5VUJ9
  ENST ID: ENST00000447569
  CDS Start-End: 93-494
aggccaggctcgccgcggggcgctgagcaggccgggacaccgcggccgaggttatcgttaggcatctcccaggcgaccggctccgcagcaagatggcggacgagaaggacagggaagagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagatggagtttcgctccgtcgcccaggctgaagtgcagtggcgtgatcttggctcgttgcaacc

SEQ ID NO: 129162 - DNA, 520 bp, Homo sapiens
  Payload ID: 5267
  Gene Symbol: EFCAB2
  Gene Name: EF-hand calcium binding domain 2
  ENST ID: ENST00000551317
  CDS Start-End: 1-395
agataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaaggtaagtgtgatttattacttatcacaatgacttatgtgaggaattaataatttgttaacagttatgcgaaagttataggggatactttaaaatcagtcattctggtgaaagttatttactgttcctgctattttggcttggggatggtttctgttctgtgggggttaagagg

SEQ ID NO: 129163 - DNA, 1542 bp, Homo sapiens
  Payload ID: 5268
  Gene Symbol: EFCAB3
  Gene Name: EF-hand calcium binding domain 3
  Uniprot ID: Q8N7B9
  ENST ID: ENST00000305286
  CDS Start-End: 79-1395
tttattggattcctgatctgattgaagcccagaagtggtaggtagcacggcttaaaagtagacagagtcactggccacatggcagtttcagaaattaaaccaaaacttaagctgaatcctctaacaaaagtacccatctcccacaataaaagggatagagacttaccaggatctcttcaatgccaattacaacacaaagaaaagaagctaagtgcttcacaaatggcagctttccaagatgcctacaacttcttctacaaggacaaaactggctgtattgatttccatggactgatgtgcactgtagctaagctgggaatgaatctgaccaagcatgatgtctataatgaattgaaatgtgctgatattgatcgagatgggaaggtgaacttctcagactttatcaaggttctaacagataagaatctcttcctcaaggcagtggttccagaaaaggagacctgtttagatttggctggcaacccaggaatcctattgtttgaaatcctatcaaggcttctagagacttcagccctacccagaaagtctataatagaaatagtaagctatttccaaagaaaattccagcatactggcccaggaatgttgtggagtccctacactatgggctatggaaaaaggacacttaagccagacatatgcacacctccaagctcaagcatggctgcctttgctaatgctgcccggattgcaataatgaaagaaaaggatttatttaaatttcttgaagagctcaagagatgcaattccggttcagatagcccatattcaaaaatacccatctttccattgttccctaatgtggatggggtggtgatgggaaagccattcaaagacatgcagaaattagagatgctaagaataaaggagcctttgcatttctttgaggattattttttccataaaagagactggaaaacacaggcagcaaatataaagtctatggaccctgcctcaggttattcaaataacatcttcaccattgatcaaatgctcaagaaaaagcagacttgtacagtggccgatgcaactgctattaaacaacatgtgaagagagctactgatacctataatttaggaattgcccttgaacaccgaaaagagatgctaaacctctggcagaagatccgaggggatttgattgggatggactctagaaatgagtccttttatgacaccttttctacttatacatggtcctggaatgtttgccaagaattactttctcctaaggacttaaggttatatgatgcctatgtgaatagaaattcctcccataactccagatcctcttcctcatcagataccagtgaatgttacacagactcaggaagaaaaagaaaacggaaaggtttaaagggatttcaacaatgaaatttctacattttctaaacagctcatcacaaactactttttcatagttatcaaaattattgtttcttgcttttgtctaagtacattcttagaagctggaaattttgacatcttttggattctgaccagtaaaaaagtttaagtcat

SEQ ID NO: 129164 - DNA, 1691 bp, Homo sapiens
  Payload ID: 5268
  Gene Symbol: EFCAB3
  Gene Name: EF-hand calcium binding domain 3
  Uniprot ID: Q8N7B9
  ENST ID: ENST00000450662
  CDS Start-End: 72-1544
ggagaggtgattgatgtccagaacttagacaatttctagcaagcgaagggattgagctcacagaagaagaaatgaaggagttgatgcctcatttgacatttaacggaaatggaaagattaatgttaattcaataatggagggcctgaagaagtttaaaccaaaaggaatggtgactctgcataagttgaaaactgcaaatgatattaaagacagagtcactggccacatggcagtttcagaaattaaaccaaaacttaagctgaatcctctaacaaaagtacccatctcccacaataaaagggatagagacttaccaggatctcttcaatgccaattacaacacaaagaaaagaagctaagtgcttcacaaatggcagctttccaagatgcctacaacttcttctacaaggacaaaactggctgtattgatttccatggactgatgtgcactgtagctaagctgggaatgaatctgaccaagcatgatgtctataatgaattgaaatgtgctgatattgatcgagatgggaaggtgaacttctcagactttatcaaggttctaacagataagaatctcttcctcaaggcagtggttccagaaaaggagacctgtttagatttggctggcaacccaggaatcctattgtttgaaatcctatcaaggcttctagagacttcagccctacccagaaagtctataatagaaatagtaagctatttccaaagaaaattccagcatactggcccaggaatgttgtggagtccctacactatgggctatggaaaaaggacacttaagccagacatatgcacacctccaagctcaagcatggctgcctttgctaatgctgcccggattgcaataatgaaagaaaaggatttatttaaatttcttgaagagctcaagagatgcaattccggttcagatagcccatattcaaaaatacccatctttccattgttccctaatgtggatggggtggtgatgggaaagccattcaaagacatgcagaaattagagatgctaagaataaaggagcctttgcatttctttgaggattattttttccataaaagagactggaaaacacaggcagcaaatataaagtctatggaccctgcctcaggttattcaaataacatcttcaccattgatcaaatgctcaagaaaaagcagacttgtacagtggccgatgcaactgctattaaacaacatgtgaagagagctactgatacctataatttaggaattgcccttgaacaccgaaaagagatgctaaacctctggcagaagatccgaggggatttgattgggatggactctagaaatgagtccttttatgacaccttttctacttatacatggtcctggaatgtttgccaagaattactttctcctaaggacttaaggttatatgatgcctatgtgaatagaaattcctcccataactccagatcctcttcctcatcagataccagtgaatgttacacagactcaggaagaaaaagaaaacggaaaggtttaaagggatttcaacaatgaaatttctacattttctaaacagctcatcacaaactactttttcatagttatcaaaattattgtttcttgcttttgtctaagtacattcttagaagctggaaattttgacatcttttggattctgaccagtaaaaaagtttaagtcat

SEQ ID NO: 129165 - DNA, 710 bp, Homo sapiens
  Payload ID: 5268
  Gene Symbol: EFCAB3
  Gene Name: EF-hand calcium binding domain 3
  ENST ID: ENST00000518576
  CDS Start-End: 223-710
agaagtggtaggtagcacggcttaaaagtaggtaaatatcgtgattttgtaggattctatgctaagtcctttttaaaaaatctattatctatgagaattgaaggtatttttttaaagaaatgattattttgaggtatggggatgatttcacagcacctttcaaatgcctgaattgttgagccattctggtgttcccagctctgtggcagagtcactggccacatggcagtttcagaaattaaaccaaaacttaagctgaatcctctaacaaaagtacccatctcccacaataaaagggatagagacttaccaggatctcttcaatgccaattacaacacaaagaaaagaagctaagtgcttcacaaatggcagctttccaagatgcctacaacttcttctacaaggacaaaactggctgtattgatttccatggactgatgtgcactgtagctaagctgggaatgaatctgaccaagcatgatgtctataatgaattgaaatgtgctgatattgatcgagatgggaaggtgaacttctcagactttatcaaggttctaacagataagaatctcttcctcaaggcagtggttccagaaaaggagacctgtttagatttggctggcaacccaggaatcctattgtttgaaatcctatcaaggcttctagagacttcagccctacccagaaagtctataatagaaatagtaag

SEQ ID NO: 129166 - DNA, 574 bp, Homo sapiens
  Payload ID: 5268
  Gene Symbol: EFCAB3
  Gene Name: EF-hand calcium binding domain 3
  ENST ID: ENST00000520404
  CDS Start-End: 52-574
attggattcctgatctgattgaagcccagaagtgacagagtcactggccacatggcagtttcagaaattaaaccaaaacttaagctgaatcctctaacaaaagtacccatctcccacaataaaagggatagagacttaccaggatctcttcaatgccaattacaacacaaagaaaagaagctaagtgcttcacaaatggcagctttccaagatgcctacaacttcttctacaaggacaaaactggctgtattgatttccatggactgatgtgcactgtagctaagctgggaatgaatctgaccaagcatgatgtctataatgaattgaaatgtgctgatattgatcgagatgggaaggtgaacttctcagactttatcaaggttctaacagataagaatctcttcctcaaggcagtggttccagaaaaggagacctgtttagatttggctggcaacccaggaatcctattgtttgaaatcctatcaaggcttctagagacttcagccctacccagaaagtctataatagaaatagtaagctatttccaaagaaaattccagcatactggcccag

SEQ ID NO: 129167 - DNA, 5132 bp, Homo sapiens
  Payload ID: 5269
  Gene Symbol: EFCAB5
  Gene Name: EF-hand calcium binding domain 5
  Uniprot ID: A4FU69
  ENST ID: ENST00000394835
  CDS Start-End: 193-4704
agttggaaaagttcagcagttgagaatttatcattcaatagaattgtggggtgaggtgagggcaggagtgagggagcttttttaacttctggagtactttgtgatgtttattaatattttctttctttttgttattaatactggtctagtaatattcttctataccatttggtgataacttttggagtccaaatgaatgagtcagcatctcaagaggaactcagacctgctcaggaaaacagaaaagaagacaaagagaggaaatggaacttaactgaagtgaaagagcttcatgagaccttacagagtgtgccagacgttcctgtaaaagaggacaccaacagtgtggtggagaaagcaatggatgaaatcaaatcccaagaattaaacctggaggggcagcgaaaaatttcacctggttcaataaaggactctaaaactgaagcctcaggtaatattgcaattagaaaatctgcaaaagtgatttttgctttagatgaaactgaactgaaatcaaagccagagcacacatggaagaaaaacctttttgaaagaatggaggcaagagcccaagcaatgcagcagaaaataatagataaggaaaatctgaagaaggaactagaaaaaaaggctgaaaaaaaactccctagggataatttggccaaagagtggtttaatactgacagcatgacactgaataatactgcatatttgcttgacaaacttctacccaccttagttcctggagtagaaaacatgttaactcaagtagaaaagaagaaggttttgacagaagctgatactccaagcaagtttgacccaattaattatttgggggaatatttaataagaaacaatcctaattatatcaaagacccaggaatgtctggttaccagaggttgatgaaagaagtcacagaagacctgaagatatatgttcctgacactatctgcaacagagtatccaagatgaaggagaatgttaaacagaatagaaaacaaagagaaagcatagacaaaatcatagtcaaggtggccaacacacggaaacaggctctgcaggagcaattcgatgaatggattctagaccctaaaggaatgattcctaagtcagtgattcagaatgttcttcaagaattctttcaaaatccagatttcaagcttggatcacactgcaaacaactggatattactgactcaacagaaccaagattgaacaaaatggaatttacagaatacatctcttcacatattaaagacttgaagagtgaaatgtttgaggaacttcttaagcacctttgccactctgcagatgaatttcgggaggtcataaaagctgacatgcggaggcagatgttcgctgaactcttcctacattgtgaccacgggaaggtagggtttttggatcggcagaggacattggccctgctggaattgttctatgaccatagttcacaaatgcttaggagtttacttcgaaacccacgacaatggccattcattgaatttgaagagataaacttgactgagttgtggggagacatggataatcagaaacacatttatgaaggttttgacaaagtgctcttggagatgaatacattactttctgcaaatcatgctagcaaaacccaaagtaaattattagaaagtccagatcaacctaaacttaacgaacagagaacatcaacaccatcaccaaacccgccagaacagcagagaggagtaactgcagaacaaggaccacaaagaatttcaattgaagaacaacaacaaggcaaaaagccaactgcagagcaagaactgtacatagaatcagtaatagaaccaggaacacacacagagtcaactctagaacaagggtcaagtagaaggttactgacagaacaagaaacacacagagagtcaactacagaacaaggacagcacaaagggtcaatagaaggacaaggaccacgcagagtgtcagtttcagaacaaggatcaagcagagagtcagttgcagaacaagggtcacgcagagagtctattgcagaacaagatcgacacaaagggtcagtagcagaacaaggatcacgcagaatgtcagctgcagaacagggatcactcagagagtcagtaatagaagaaccataccaaaaatcagaacaaggaccttatggagagataatttcagaagagcaagaagacataggctcaacttcacaatcaagaaaagatagtatcttaaaaagtacaaaatatggggaacctataacctctgagtacattgaagtccctctacaggaaaagaggtcttgggaacaaacatatgaagaggaaatattcctgagttctgaactgcaagaggaagttccaaccttaagcagaaaagatcactttccagaaactacaaaaaaggaagttcagaaagacaagccctgtgaacccaagtcccaaaaaatagaaggaaagtcatggtcaggtgaattttttacttgtaactggaaaatgaagtatgtcacatttgaagatgaggaacaggcaaacttaatctatggtaactccaggttcacagatttacactcaattatcagaaatattcagtcttgcaaggaggtaaaaggcagaactgccttcaatggagtttcattcaatctgctccagtttgtgcaactcctggagacatttgttggtgaagacgctcccttgagtgtcagcgagactctcacctccttttttaaggagggctatgttgaaacagaacaagagaaaatgaatgccttagaacagtttagccaaaatgctttccaagtccgacagaggcttctcctagaagccatctttcagaagtgggacagtgatggctcaggcttcctggatctgaaggaagttgatgaactcttgtacacatacaaggagggaatggaaaaagaatctatgaagaaagctaaactacacatccaatttccaaagccacaccctggtcacgaagtgagattgtcttcaaaacaatttcagaattacatagaattggttgtgtctgaactcaggggcaatgaagaccaagttctggaaagtgttgtggaatttctgatgaatgctttagagaggagccacattgagagtctgaggaattctgccaggcggaaatggctgcaccaaatccaatgtgctgcagagacaagtggggtgtccctagagccggtgtatagtgagacctttaaggccctcatgcaggatgctgaagcccatggaaataaaaagatcagtgctcacatttccctcttagaagaaaacctactactgcctgagaaagggaatgttctattgaggaatgtggcttgtaccttagatgatgctcaatttgtactgaacagagtgctctacagggacatgaaaggaatcagctttacagtagtggatgaagggaagccaatccatgttccccaagttcagtaccatgggaacatcttcttctggaaccagtcccgtaataagcatgattataatggttcattcctggctctgcctcttcaagatgcatatatgaggatctttggggtcttggctgttgatacccttagagatccccacgaaataaacatctttctacctcatgagatcagattctatcagggtgttgctaatgtctttagcactgcctatcactacgtccacagccgggagcacattctgcatattgtgatcactggcataggctggctttatgacgtcacatccagcatcacctccatcactacgtactttgtagagcctagcccagcccaggattcagactatgttttacgcaacatgatggttacagggcagctgggtctaacagaaatccacaaaaatcctcctaccatccacaggaagtcatgcatcttcagagatttcctctttaaatgtactgacagttcagaagttgttctggcttctgcctgtggagaaacgcatatagtagttccacttcgtgagagaacaggagaggctctgggagtcctcgattttaacatcggccaaaataggatgttgttgtgtcaagaatataaagatctacagaaaatgatgaaagtggtccaagtggcctgctatgaaatacttggcgagttctctggagagataaagaaaaaatatatcttagagattgaaaatgtcagggaagtccagcgggcaggaattctcttcttccgaatcatgctgctcgagctacaggaaagcatccaactactcaattccatggaatttgtgtcactgttgctctatgaccatactcttgtaacagagccaaattctcctcaagacagcaaatctatggagttggaagccaacgtgaaactagtgcgtgacatcctgaaggcggttatcttgttctttcatccagagttggaattttcaagtgactttggaagttgggataagtgtaaattttatgttaacaaatatttagtcaacaatatttgtgcctttgatccaactgccaagcatgtggaagttaatgtacagcttattgatgaatatatcagagatcattcccgaactgaagtatggaaatttggtaatgttgtcattgaacatctataccactggatacacatctgttcagctctcatgaagataaccaaacaactaaatagtggtattacacctccgttgccctccaagactgacaattatatgtatgcaaaaatgccaggggaaggtttgcaagagaagtgataatggatgataatggaattgatactgtatttaggatcctttgtttgttatcagttttgtttgttaactataaaatattttccattggaaaggggtacctataaatgtcttctgctgctaatatttatctcagcactttctaaacccaaaagtgctacctaagaagaaatttagccaaaaaatacccagctaaggtagccatagccaagtgtatttaagtatgttatagaatatatttgaaagcttcctttcagtttgagctttgtatctgctgtggaactgttatggttgattgggtagttatttttcattcttataaggttcaaagtaacagctgaggatttagaaaacaagaataccaaatagaatacgaaataataaagataaaccaaaagaataccaaataataaagatttttaagaaatgga

SEQ ID NO: 129168 - DNA, 2454 bp, Homo sapiens
  Payload ID: 5269
  Gene Symbol: EFCAB5
  Gene Name: EF-hand calcium binding domain 5
  ENST ID: ENST00000423598
  CDS Start-End: 240-410
agtggcgttcggcgggacccgctgaggcaaagcggagccgcagtgacagaagcaagcggagcggccgccaggaaggactcaccgaggcgcaggggctggaggtggtgctgggggaaaacagaaaagaagacaaagagaggaaatggaacttaactgaagtgaaagagcttcatgagaccttacagagtgtgccagacgttcctgtaaaagaggacaccaacagtgtggtggagaaagcaatggatgaaatcaaatcccaagaattaaacctggaggggcagcgaaaaatttcacctggttcaataaaggactctaaaactgaagcctcagattcagaatgttcttcaagaattctttcaaaatccagatttcaagcttggatcacactgcaaacaactggatattactgactcaacagaaccaagattgaacaaaatggaatttacagaatacatctcttcacatattaaagacttgaagagtgaaatgtttgaggaacttcttaagcacctttgccactctgcagatgaatttcgggaggtcataaaagctgacatgcggaggcagatgttcgctgaactcttcctacattgtgaccacgggaaggtagggtttttggatcggcagaggacattggccctgctggaattgttctatgaccatagttcacaaatgcttaggagtttacttcgaaacccacgacaatggccattcattgaatttgaagagataaacttgactgagttgtggggagacatggataatcagaaacacatttatgaaggttttgacaaagtgctcttggagatgaatacattactttctgcaaatcatgctagcaaaacccaaagtaaattattagaaagtccagatcaacctaaacttaacgaacagagaacatcaacaccatcaccaaacccgccagaacagcagagaggagtaactgcagaacaaggaccacaaagaatttcaattgaagaacaacaacaaggcaaaaagccaactgcagagcaagaactgtacatagaatcagtaatagaaccaggaacacacacagagtcaactctagaacaagggtcaagtagaaggttactgacagaacaagaaacacacagagagtcaactacagaacaaggacagcacaaagggtcaatagaaggacaaggaccacgcagagtgtcagtttcagaacaaggatcaagcagagagtcagttgcagaacaagggtcacgcagagagtctattgcagaacaagatcgacacaaagggtcagtagcagaacaaggatcacgcagaatgtcagctgcagaacagggatcactcagagagtcagtaatagaagaaccataccaaaaatcagaacaaggaccttatggagagataatttcagaagagcaagaagacataggctcaacttcacaatcaagaaaagatagtatcttaaaaagtacaaaatatggggaacctataacctctgagtacattgaagtccctctacaggaaaagaggtcttgggaacaaacatatgaagaggaaatattcctgagttctgaactgcaagaggaagttccaaccttaagcagaaaagatcactttccagaaactacaaaaaaggaagttcagaaagacaagccctgtgaacccaagtcccaaaaaatagaaggaaagtcatggtcaggtgaattttttacttgtaactggaaaatgaagtatgtcacatttgaagatgaggaacaggcaaacttaatctatggtaactccaggttcacagatttacactcaattatcagaaatattcagtcttgcaaggaggtaaaaggcagaactgccttcaatggagtttcattcaatctgctccagtttgtgcaactcctggagacatttgttggtgaagacgctcccttgagtgtcagcgagactctcacctccttttttaaggagggctatgttgaaacagaacaagagaaaatgaatgccttagaacaggtctcactctgtcgccaggctggagtgcagtggcgcaactgtagctcactgcagcctccaactcccggactcaagcgatcatcccatcacagactcctgagcaactgggactacagggaaagaaggaagttttttcctcttgagaccaaatttccataaaatgagatgcaaaaattttaagtgtatatttgctgagttttgacaaatacatgccctatgcatcccatactcctatcaagatacagaacaaagagcactgtgacactcacctgtaatcccagctactcaagaggcagaggcaggaagattgcttgagcccaggagttcaagatcagcctgggtaacattgcaaaaaccatctcttaaaaaaaataaataaaagatatagaacaaaaaaagtccccacacctctttcccattcagtcgtccaccctccaatccccaaagcaaccacttttctattttcta

SEQ ID NO: 129169 - DNA, 3965 bp, Homo sapiens
  Payload ID: 5269
  Gene Symbol: EFCAB5
  Gene Name: EF-hand calcium binding domain 5
  Uniprot ID: A4FU69
  ENST ID: ENST00000440741
  CDS Start-End: 130-2910
aggagtgagggagcttttttaacttctggagtactttgtgatgtttattaatattttctttctttttgttattaatactggtctagtaatattcttctataccatttggtgataacttttggagtccaaatgaatgagtcagcatctcaagaggaactcagacctgctcaggaaaacagaaaagaagacaaagagaggaaatggaacttaactgaagtgaaagagcttcatgagaccttacagagtgtgccagacgttcctgtaaaagaggacaccaacagtgtggtggagaaagcaatggatgaaatcaaatcccaagaattaaacctggaggggcagcgaaaaatttcacctggttcaataaaggactctaaaactgaagcctcaggtaatattgcaattagaaaatctgcaaaagtgatttttgctttagatgaaactgaactgaaatcaaagccagagcacacatggaagaaaaacctttttgaaagaatggaggcaagagcccaagcaatgcagcagaaaataatagataaggaaaatctgaagaaggaactagaaaaaaaggctgaaaaaaaactccctagggataatttggccaaagagtggtttaatactgacagcatgacactgaataatactgcatatttgcttgacaaacttctacccaccttagttcctggagtagaaaacatgttaactcaagtagaaaagaagaaggttttgacagaagctgatactccaagcaagtttgacccaattaattatttgggggaatatttaataagaaacaatcctaattatatcaaagacccaggaatgtctggttaccagaggttgatgaaagaagtcacagaagacctgaagatatatgttcctgacactatctgcaacagagtatccaagatgaaggagaatgttaaacagaatagaaaacaaagagaaagcatagacaaaatcatagtcaaggtggccaacacacggaaacaggctctgcaggagcaattcgatgaatggattctagaccctaaaggaatgattcctaagtcagtgattcagaatgttcttcaagaattctttcaaaatccagatttcaagcttggatcacactgcaaacaactggatattactgactcaacagaaccaagattgaacaaaatggaatttacagaatacatctcttcacatattaaagacttgaagagtgaaatgtttgaggaacttcttaagcacctttgccactctgcagatgaatttcgggaggtcataaaagctgacatgcggaggcagatgttcgctgaactcttcctacattgtgaccacgggaaggtagggtttttggatcggcagaggacattggccctgctggaattgttctatgaccatagttcacaaatgcttaggagtttacttcgaaacccacgacaatggccattcattgaatttgaagagataaacttgactgagttgtggggagacatggataatcagaaacacatttatgaaggttttgacaaagtgctcttggagatgaatacattactttctgcaaatcatgctagcaaaacccaaagtaaattattagaaagtccagatcaacctaaacttaacgaacagagaacatcaacaccatcaccaaacccgccagaacagcagagaggagtaactgcagaacaaggaccacaaagaatttcaattgaagaacaacaacaaggcaaaaagccaactgcagagcaagaactgtacatagaatcagtaatagaaccaggaacacacacagagtcaactctagaacaagggtcaagtagaaggttactgacagaacaagaaacacacagagagtcaactacagaacaaggacagcacaaagggtcaatagaaggacaaggaccacgcagagtgtcagtttcagaacaaggatcaagcagagagtcagttgcagaacaagggtcacgcagagagtctattgcagaacaagatcgacacaaagggtcagtagcagaacaaggatcacgcagaatgtcagctgcagaacagggatcactcagagagtcagtaatagaagaaccataccaaaaatcagaacaaggaccttatggagagataatttcagaagagcaagaagacataggctcaacttcacaatcaagaaaagatagtatcttaaaaagtacaaaatatggggaacctataacctctgagtacattgaagtccctctacaggaaaagaggtcttgggaacaaacatatgaagaggaaatattcctgagttctgaactgcaagaggaagttccaaccttaagcagaaaagatcactttccagaaactacaaaaaaggaagttcagaaagacaagccctgtgaacccaagtcccaaaaaatagaaggaaagtcatggtcaggtgaattttttacttgtaactggaaaatgaagtatgtcacatttgaagatgaggaacaggcaaacttaatctatggtaactccaggttcacagatttacactcaattatcagaaatattcagtcttgcaaggaggtaaaaggcagaactgccttcaatggagtttcattcaatctgctccagtttgtgcaactcctggagacatttgttggtgaagacgctcccttgagtgtcagcgagactctcacctccttttttaaggagggctatgttgaaacagaacaagagaaaatgaatgccttagaacagtttagccaaaatgctttccaagtccgacagaggcttctcctagaagccatctttcagaagtgggacagtgatggctcaggcttcctggatctgaaggaagttgatgaactcttgtacacatacaaggagggaatggaaaaagaatctatgaagaaaggtctcactctgtcgccaggctggagtgcagtggcgcaactgtagctcactgcagcctccaactcccggactcaagcgatcatcccatcacagactcctgagcaactgggactacagggaaagaaggaagttttttcctcttgagaccaaatttccataaaatgagatgcaaaaattttaagtgtatatttgctgagttttgacaaatacatgccctatgcatcccatactcctatcaagatacagaacaaagagcactgtgacactcacctgtaatcccagctactcaagaggcagaggcaggaagattgcttgagcccaggagttcaagatcagcctgggtaacattgcaaaaaccatctcttaaaaaaaataaataaaagatatagaacaaaaaaagtccccacacctctttcccattcagtcgtccaccctccaatccccaaagcaaccacttttctattttctaccataaattagttttatctcttctggaatttcataaaaatgaaattatacagtatgcatctttttttacagagtttaaactctatgtactctttttgtaaggcttctttcactcagcataatttttacttttttaaaaattttttgggggagacagagtctcactctgttgcccaagctggagtgtagtggcatgtgatcataactcactgcagccttgaactcttgggctcaagcaatcctcccgcctcagcatcccgagtagctgggagactacaggtgcacaccaccatgcctggctagtttataaactttttgtagagacaaggtctcaccatgttgcccaggctggccactaactcctggcctcaagtgatcctccctccttagcctcccaaagctctgaattatattcataagccactgggcctggttgactcagcataatttttcttgagagtcttaatatgttgctacatgtatcagcaatttgcttctttttattgctgagtagtattccattgtatgaatacaccatggtttgtttatccgttttcctatgtatggacacctgggctgtttccagttcttagctattataaataaagctactctgcacaatcttaagtaaa

SEQ ID NO: 129170 - DNA, 566 bp, Homo sapiens
  Payload ID: 5269
  Gene Symbol: EFCAB5
  Gene Name: EF-hand calcium binding domain 5
  ENST ID: ENST00000448319
  CDS Start-End: 257-566
atacaaacacgaccttagaacaagaatgatcacgagcaatgagtgtaaggcataaatatctgtaagacggaaataatttgacactgatcactaagcagcaccagatgcttcgggacctcataaaggaaaggaaaacagaaaagaagacaaagagaggaaatggaacttaactgaagtgaaagagcttcatgagaccttacagagtgtgccagacgttcctgtaaaagaggacaccaacagtgtggtggagaaagcaatggatgaaatcaaatcccaagaattaaacctggaggggcagcgaaaaatttcacctggttcaataaaggactctaaaactgaagcctcaggtaatattgcaattagaaaatctgcaaaagtgatttttgctttagatgaaactgaactgaaatcaaagccagagcacacatggaagaaaaacctttttgaaagaatggaggcaagagcccaagcaatgcagcagaaaataatagataaggaaaatctgaagaaggaactagaaaaaaaggctgaaaaaaaactccctagggataatttggccaaagagt

SEQ ID NO: 129171 - DNA, 3986 bp, Homo sapiens
  Payload ID: 5269
  Gene Symbol: EFCAB5
  Gene Name: EF-hand calcium binding domain 5
  ENST ID: ENST00000419434
  CDS Start-End: 1-3558
aagaagaaggttttgacagaagctgatactccaagcaagtttgacccaattaattatttgggggaatatttaataagaaacaatcctaattatatcaaagacccaggaatgtctggttaccagaggttgatgaaagaagtcacagaagacctgaagatatatgttcctgacactatctgcaacagagtatccaagatgaaggagaatgttaaacagaatagaaaacaaagagaaagcatagacaaaatcatagtcaaggtggccaacacacggaaacaggctctgcaggagcaattcgatgaatggattctagaccctaaaggaatgattcctaagtcagtgattcagaatgttcttcaagaattctttcaaaatccagatttcaagcttggatcacactgcaaacaactggatattactgactcaacagaaccaagattgaacaaaatggaatttacagaatacatctcttcacatattaaagacttgaagagtgaaatgtttgaggaacttcttaagcacctttgccactctgcagatgaatttcgggaggtcataaaagctgacatgcggaggcagatgttcgctgaactcttcctacattgtgaccacgggaaggtagggtttttggatcggcagaggacattggccctgctggaattgttctatgaccatagttcacaaatgcttaggagtttacttcgaaacccacgacaatggccattcattgaatttgaagagataaacttgactgagttgtggggagacatggataatcagaaacacatttatgaaggttttgacaaagtgctcttggagatgaatacattactttctgcaaatcatgctagcaaaacccaaagtaaattattagaaagtccagatcaacctaaacttaacgaacagagaacatcaacaccatcaccaaacccgccagaacagcagagaggagtaactgcagaacaaggaccacaaagaatttcaattgaagaacaacaacaaggcaaaaagccaactgcagagcaagaactgtacatagaatcagtaatagaaccaggaacacacacagagtcaactctagaacaagggtcaagtagaaggttactgacagaacaagaaacacacagagagtcaactacagaacaaggacagcacaaagggtcaatagaaggacaaggaccacgcagagtgtcagtttcagaacaaggatcaagcagagagtcagttgcagaacaagggtcacgcagagagtctattgcagaacaagatcgacacaaagggtcagtagcagaacaaggatcacgcagaatgtcagctgcagaacagggatcactcagagagtcagtaatagaagaaccataccaaaaatcagaacaaggaccttatggagagataatttcagaagagcaagaagacataggctcaacttcacaatcaagaaaagatagtatcttaaaaagtacaaaatatggggaacctataacctctgagtacattgaagtccctctacaggaaaagaggtcttgggaacaaacatatgaagaggaaatattcctgagttctgaactgcaagaggaagttccaaccttaagcagaaaagatcactttccagaaactacaaaaaaggaagttcagaaagacaagccctgtgaacccaagtcccaaaaaatagaaggaaagtcatggtcaggtgaattttttacttgtaactggaaaatgaagtatgtcacatttgaagatgaggaacaggcaaacttaatctatggtaactccaggttcacagctaaactacacatccaatttccaaagccacaccctggtcacgaagtgagattgtcttcaaaacaatttcagaattacatagaattggttgtgtctgaactcaggggcaatgaagaccaagttctggaaagtgttgtggaatttctgatgaatgctttagagaggagccacattgagagtctgaggaattctgccaggcggaaatggctgcaccaaatccaatgtgctgcagagacaagtggggtgtccctagagccggtgtatagtgagacctttaaggccctcatgcaggatgctgaagcccatggaaataaaaagatcagtgctcacatttccctcttagaagaaaacctactactgcctgagaaagggaatgttctattgaggaatgtggcttgtaccttagatgatgctcaatttgtactgaacagagtgctctacagggacatgaaaggaatcagctttacagtagtggatgaagggaagccaatccatgttccccaagttcagtaccatgggaacatcttcttctggaaccagtcccgtaataagcatgattataatggttcattcctggctctgcctcttcaagatgcatatatgaggatctttggggtcttggctgttgatacccttagagatccccacgaaataaacatctttctacctcatgagatcagattctatcagggtgttgctaatgtctttagcactgcctatcactacgtccacagccgggagcacattctgcatattgtgatcactggcataggctggctttatgacgtcacatccagcatcacctccatcactacgtactttgtagagcctagcccagcccaggattcagactatgttttacgcaacatgatggttacagggcagctgggtctaacagaaatccacaaaaatcctcctaccatccacaggaagtcatgcatcttcagagatttcctctttaaatgtactgacagttcagaagttgttctggcttctgcctgtggagaaacgcatatagtagttccacttcgtgagagaacaggagaggctctgggagtcctcgattttaacatcggccaaaataggatgttgttgtgtcaagaatataaagatctacagaaaatgatgaaagtggtccaagtggcctgctatgaaatacttggcgagttctctggagagataaagaaaaaatatatcttagagattgaaaatgtcagggaagtccagcgggcaggaattctcttcttccgaatcatgctgctcgagctacaggaaagcatccaactactcaattccatggaatttgtgtcactgttgctctatgaccatactcttgtaacagagccaaattctcctcaagacagcaaatctatggagttggaagccaacgtgaaactagtgcgtgacatcctgaaggcggttatcttgttctttcatccagagttggaattttcaagtgactttggaagttgggataagtgtaaattttatgttaacaaatatttagtcaacaatatttgtgcctttgatccaactgccaagcatgtggaagttaatgtacagcttattgatgaatatatcagagatcattcccgaactgaagtatggaaatttggtaatgttgtcattgaacatctataccactggatacacatctgttcagctctcatgaagataaccaaacaactaaatagtggtattacacctccgttgccctccaagactgacaattatatgtatgcaaaaatgccaggggaaggtttgcaagagaagtgataatggatgataatggaattgatactgtatttaggatcctttgtttgttatcagttttgtttgttaactataaaatattttccattggaaaggggtacctataaatgtcttctgctgctaatatttatctcagcactttctaaacccaaaagtgctacctaagaagaaatttagccaaaaaatacccagctaaggtagccatagccaagtgtatttaagtatgttatagaatatatttgaaagcttcctttcagtttgagctttgtatctgctgtggaactgttatggttgattgggtagttatttttcattcttataaggttcaaagtaacagctgaggatttagaaaacaagaataccaaatagaatacgaaataataaagataaaccaaaagaataccaaataataaagatttttaagaaatgga

SEQ ID NO: 129172 - DNA, 2826 bp, Homo sapiens
  Payload ID: 5269
  Gene Symbol: EFCAB5
  Gene Name: EF-hand calcium binding domain 5
  Uniprot ID: A4FU69
  ENST ID: ENST00000536908
  CDS Start-End: 193-2763
agaagcaagcggagcggccgccaggaaggactcaccgaggcgcaggggctggaggtggtgctgggggaaaacagaaaagaagacaaagagaggaaatggaacttaactgaagtgaaagagcttcatgagaccttacagagtgtgccagacgttcctgtaaaagaggacaccaacagtgtggtggagaaagcaatggatgaaatcaaatcccaagaattaaacctggaggggcagcgaaaaatttcacctggttcaataaaggactctaaaactgaagcctcaggtaatattgcaattagaaaatctgcaaaagtgatttttgctttagatgaaactgaactgaaatcaaagccagagcacacatggaagaaaaacctttttgaaagaatggaggcaagagcccaagcaatgcagcagaaaataatagataaggaaaatctgaagaaggaactagaaaaaaaggctgaaaaaaaactccctagggataatttggccaaagagtggtttaatactgacagcatgacactgaataatactgcatatttgcttgacaaacttctacccaccttagttcctggagtagaaaacatgttaactcaagtagaaaagaagaaggttttgacagaagctgatactccaagcaagtttgacccaattaattatttgggggaatatttaataagaaacaatcctaattatatcaaagacccaggaatgtctggttaccagaggttgatgaaagaagtcacagaagacctgaagatatatgttcctgacactatctgcaacagagtatccaagatgaaggagaatgttaaacagaatagaaaacaaagagaaagcatagacaaaatcatagtcaaggtggccaacacacggaaacaggctctgcaggagcaattcgatgaatggattctagaccctaaaggaatgattcctaagtcagtgattcagaatgttcttcaagaattctttcaaaatccagatttcaagcttggatcacactgcaaacaactggatattactgactcaacagaaccaagattgaacaaaatggaatttacagaatacatctcttcacatattaaagacttgaagagtgaaatgtttgaggaacttcttaagcacctttgccactctgcagatgaatttcgggaggtcataaaagctgacatgcggaggcagatgttcgctgaactcttcctacattgtgaccacgggaaggtagggtttttggatcggcagaggacattggccctgctggaattgttctatgaccatagttcacaaatgcttaggagtttacttcgaaacccacgacaatggccattcattgaatttgaagagataaacttgactgagttgtggggagacatggataatcagaaacacatttatgaaggttttgacaaagtgctcttggagatgaatacattactttctgcaaatcatgctagcaaaacccaaagtaaattattagaaagtccagatcaacctaaacttaacgaacagagaacatcaacaccatcaccaaacccgccagaacagcagagaggagtaactgcagaacaaggaccacaaagaatttcaattgaagaacaacaacaaggcaaaaagccaactgcagagcaagaactgtacatagaatcagtaatagaaccaggaacacacacagagtcaactctagaacaagggtcaagtagaaggttactgacagaacaagaaacacacagagagtcaactacagaacaaggacagcacaaagggtcaatagaaggacaaggaccacgcagagtgtcagtttcagaacaaggatcaagcagagagtcagttgcagaacaagggtcacgcagagagtctattgcagaacaagatcgacacaaagggtcagtagcagaacaaggatcacgcagaatgtcagctgcagaacagggatcactcagagagtcagtaatagaagaaccataccaaaaatcagaacaaggaccttatggagagataatttcagaagagcaagaagacataggctcaacttcacaatcaagaaaagatagtatcttaaaaagtacaaaatatggggaacctataacctctgagtacattgaagtccctctacaggaaaagaggtcttgggaacaaacatatgaagaggaaatattcctgagttctgaactgcaagaggaagttccaaccttaagcagaaaagatcactttccagaaactacaaaaaaggaagttcagaaagacaagccctgtgaacccaagtcccaaaaaatagaaggaaagtcatggtcaggtgaattttttacttgtaactggaaaatgaagtatgtcacatttgaagatgaggaacaggcaaacttaatctatggtaactccaggttcacagatttacactcaattatcagaaatattcagtcttgcaaggaggtaaaaggcagaactgccttcaatggagtttcattcaatctgctccagtttgtgcaactcctggagacatttgttggtgaagacgctcccttgagtgtcagcgagactctcacctccttttttaaggagggctatgttgaaacagaacaagagaaaatgaatgccttagaacaggtctcactctgtcgccaggctggagtgcagtggcgcaactgtagctcactgcagcctccaactcccggactcaagcgatcatcccatcacagactcctgagcaactgggactacagggaaagaaggaagttttttcctcttgagaccaaatttccataaaatgagatgcaaaaattttaagtgtatatttgctgagttttgacaaatacatgccctatgcat

SEQ ID NO: 129173 - DNA, 2605 bp, Homo sapiens
  Payload ID: 5269
  Gene Symbol: EFCAB5
  Gene Name: EF-hand calcium binding domain 5
  ENST ID: ENST00000588978
  CDS Start-End: 1-2323
tgatactccaagcaagtttgacccaattaattatttgggggaatatttaataagaaacaatcctaattatatcaaagacccaggaatgtctggttaccagaggttgatgaaagaagtcacagaagacctgaagatatatgttcctgacactatctgcaacagagtatccaagatgaaggagaatgttaaacagaatagaaaacaaagagaaagcatagacaaaatcatagtcaaggtggccaacacacggaaacaggctctgcaggagcaattcgatgaatggattctagaccctaaaggaatgattcctaagtcagtgattcagaatgttcttcaagaattctttcaaaatccagatttcaagcttggatcacactgcaaacaactggatattactgactcaacagaaccaagattgaacaaaatggaatttacagaatacatctcttcacatattaaagacttgaagagtgaaatgtttgaggaacttcttaagcacctttgccactctgcagatgaatttcgggaggtcataaaagctgacatgcggaggcagatgttcgctgaactcttcctacattgtgaccacgggaaggtagggtttttggatcggcagaggacattggccctgctggaattgttctatgaccatagttcacaaatgcttaggagtttacttcgaaacccacgacaatggccattcattgaatttgaagagataaacttgactgagttgtggggagacatggataatcagaaacacatttatgaaggttttgacaaagtgctcttggagatgaatacattactttctgcaaatcatgctagcaaaacccaaagtaaattattagaaagtccagatcaacctaaacttaacgaacagagaacatcaacaccatcaccaaacccgccagaacagcagagaggagtaactgcagaacaaggaccacaaagaatttcaattgaagaacaacaacaaggcaaaaagccaactgcagagcaagaactgtacatagaatcagtaatagaaccaggaacacacacagagtcaactctagaacaagggtcaagtagaaggttactgacagaacaagaaacacacagagagtcaactacagaacaaggacagcacaaagggtcaatagaaggacaaggaccacgcagagtgtcagtttcagaacaaggatcaagcagagagtcagttgcagaacaagggtcacgcagagagtctattgcagaacaagatcgacacaaagggtcagtagcagaacaaggatcacgcagaatgtcagctgcagaacagggatcactcagagagtcagtaatagaagaaccataccaaaaatcagaacaaggaccttatggagagataatttcagaagagcaagaagacataggctcaacttcacaatcaagaaaagatagtatcttaaaaagtacaaaatatggggaacctataacctctgagtacattgaagtccctctacaggaaaagaggtcttgggaacaaacatatgaagaggaaatattcctgagttctgaactgcaagaggaagttccaaccttaagcagaaaagatcactttccagaaactacaaaaaaggaagttcagaaagacaagccctgtgaacccaagtcccaaaaaatagaaggaaagtcatggtcaggtgaattttttacttgtaactggaaaatgaagtatgtcacatttgaagatgaggaacaggcaaacttaatctatggtaactccaggttcacagatttacactcaattatcagaaatattcagtcttgcaaggaggtaaaaggcagaactgccttcaatggagtttcattcaatctgctccagtttgtgcaactcctggagacatttgttggtgaagacgctcccttgagtgtcagcgagactctcacctccttttttaaggagggctatgttgaaacagaacaagagaaaatgaatgccttagaacagtttagccaaaatgctttccaagtccgacagaggcttctcctagaagccatctttcagaagtgggacagtgatggctcaggcttcctggatctgaaggaagttgatgaactcttgtacacatacaaggagggaatggaaaaagaatctatgaagaaagatcattcccgaactgaagtatggaaatttggtaatgttgtcattgaacatctataccactggatacacatctgttcagctctcatgaagataaccaaacaactaaatagtggtattacacctccgttgccctccaagactgacaattatatgtatgcaaaaatgccaggggaaggtttgcaagagaagtgataatggatgataatggaattgatactgtatttaggatcctttgtttgttatcagttttgtttgttaactataaaatattttccattggaaaggggtacctataaatgtcttctgctgctaatatttatctcagcactttctaaacccaaaagtgctacctaagaagaaatttagccaaaaaatacccagctaaggtagccatagccaagtgtatttaagtatgttatagaatatatttgaaagcttcctttcagtttgagctttgtatctgctgtggaactg

SEQ ID NO: 129174 - DNA, 4869 bp, Homo sapiens
  Payload ID: 5270
  Gene Symbol: EFCAB6
  Gene Name: EF-hand calcium binding domain 6
  Uniprot ID: Q5THR3
  ENST ID: ENST00000262726
  CDS Start-End: 255-4760
aacagcgtcctagagacgccgaatgggcagcccctctgagaccccgcggcttggggtccgcgcacgcgggtgccggcccagctaggcggagaatcgaggaggggttcccgggctcatcgcagaggattggaagggcctagattactgcccaatgacaaaagtgtgggcttaatgtcctcactcttcagggagagaatgtggactttagcatttgaactgaatatttgagattgaagatttctgaataggatttaatgtgcaaaatggcgattataccagactggcttaggtcgcatcctcacacacgaaaatttacacattcaagaccccattcttcaccgtgtagagtatattcaaggaatggttccccaaataagttcagatcttcttcaaccacagctgttgcaaatccaacactgtcctccttagatgttaaacggattttatttcaaaaaattaccgacagaggggatgagttgcaaaaagcctttcagctgctggatactggtcagaacttgactgtgtcaaaaagtgaactgagaagaatcatcacagacttcctgatgccgctcacacgagaacagtttcaggacgtgttggctcagatcccccttagcacctctggtactgtaccgtaccttgcctttctgtccaggtttggtggaattgacctatatataaatggtataaagaggggaggtgggaatgaaatgaattgctgccgcacattaagagaacttgaaatccaagtgggagaaaaggttttcaaaaacattaagactgttatgaaagcctttgagctcattgatgttaacaagactggactggttcgaccgcaggagctaagaagggttctggagaccttctgtatgaagttaagagacgaggaatacgaaaagttttcgaaacactacaacatccacaaggatactgcagtagattacaacgtgtttttgaagaatctcagcataaataacgacttgaaccttagatattgtatgggaaatcaagaggtctcgttggagaatcaacaagccaaaaattccaaaaaggaacgtttgctaggttctgcatcatctgaagatatctggagaaactactccttggatgaaattgagaggaacttttgtctacaactttcgaagtcttatgaaaaggttgaaaaggccctcagtgcaggggacccctgtaaaggtggctacgtgtcttttaattatctaaagattgtcctcgacacttttgtataccaaataccaagaagaatttttatccagttaatgaaaagatttggacttaaagccaccactaaaatcaattggaagcaatttctaacatcatttcatgagcctcaggggttgcaagttagcagtaaaggtcccctgacaaaaagaaatagcatcaactctagaaatgaatctcacaaggaaaacatcatcacaaagttatttagacacactgaagatcactctgcgtcactgaagaaagcattactgataatcaacactaaacccgatggaccgataacaagagaagaatttcgatatattctaaattgcatggctgtaaaactaagcgattcagaattcaaagaactaatgcaaatgcttgaccctggggacactggagtggtcaacaccagcatgtttattgatctgattgaagagaactgtaggatgagaaagacatctccctgtacagatgctaagacacctttcctcctggcctgggattcagtggaagaaattgttcatgatacaattactaggaacctacaagctttttataacatgctacgctcatatgaccttggagacacagggcgcattggccgaaataatttcaagaaaatcatgcacgtcttctgtccatttttaacgaatgcacatttcataaaactctgcagtaagattcaggacattggttcaggaagaatcctttacaagaaacttttggcatgcataggaattgatggcccacccactgtctctccagttcttgttccaaaggatcagctgttaagtgaacatttacaaaaagatgaacagcagcagccagatctttctgagagaaccaagctcacggaggataaaaccaccctgaccaagaagatgaccacagaagaagtgattgaaaaattcaaaaagtgtatacagcagcaggacccggcattcaaaaaacgatttcttgacttcagcaaggagcctaatggaaaaattaacgtgcatgactttaagaaggtactggaagacactgggatgcccatggacgatgatcagtatgccctgctgaccactaaaataggcttcgagaaggaagggatgagctatcttgattttgcagcaggatttgaagatcctccaatgagagggccggaaaccactccgccgcagcctccaactccttcaaaaagttacgtgaacagccactttatcaccgcagaagaatgcctgaagcttttccctaggaggctgaaggagtcattccgggacccctactctgccttctttaaaacagatgctgacagggatggcataatcaacatgcatgaccttcacagactgctcctgcatctactgcttaatctcaaagacgacgagtttgagcgcttccttggccttcttggcttgagacttagtgtcactttaaattttcgggaatttcaaaatttgtgtgagaagagaccatggagaacagatgaagcgcctcaaagactcattagaccaaaacagaaggttgcggattcagaactagcttgtgagcaggctcatcagtatcttgttaccaaagcaaaaaacagatggtcagacttgtctaagaattttctagaaaccgataatgagggcaatggcattcttcgacgccgggacataaagaacgcactgtacggttttgatattcccctcacaccaagagagtttgaaaagctttgggcaagatacgacaccgagggaaaagggcacattacttaccaggaatttttacagaaattgggtattaactattcgcctgctgtccatcggccctgtgcagaggattatttcaacttcatgggtcattttacaaagccacagcagctacaggaagagatgaaggagctgcagcagagcacagagaaggctgtggcagccagggataagcttatggaccgccatcaagatatcagcaaagcattcaccaaaactgatcaatccaaaaccaactacatatccatatgcaagatgcaggaagtgctggaagaatgtggatgttctcttaccgaaggggagctgacccatctgctaaacagttggggagtcagccggcatgataatgctatcaattacctcgacttcctgagagcagtggagaacagcaagtcaacaggagctcagcccaaggaaaaagaagagagcatgccaatcaattttgcaacgctgaatccacaggaggctgtgaggaagatccaggaagtagttgagtcctcccagctggctttgtccacggcattttctgcattggataaagaggatacaggatttgtaaaggctacagaattcggacaagttcttaaggatttctgttacaaactaacggacaatcagtatcattattttttgaggaaactaagaattcatctaaccccctatataaattggaaatattttctccagaactttagctgtttccttgaggagacagctgatgagtgggctgagaaaatgcccaaaggcccgccgcctacctctcccaaggccacagccgacagagacatcctggctcgcctccacaaagcagtgacttcccattaccatgccatcacccaggagtttgagaattttgacaccatgaaaacgaacaccatctccagagaggagtttagggccatttgtaatcgccgcgtccaaatcctgacggacgaacagtttgacagactctggaacgagatgccagtcaatgccaaggggaggctgaaatacccggacttcctgagcaggttcagttccgagacagcagccacaccaatggccactggtgactcggccgtggcccagagagggagcagtgtccctgacgtctcggaaggcaccagatctgccctctcattgcccactcaggagctgagaccagggtcaaagtcgcagagccacccctgtactccagcgagcaccaccgtgatcccgggcactccacccttgcagaactgtgatcccatagagagcaggctccggaagagaatccagggctgctggcgccagctcctgaaagaatgcaaggagaaggacgtggccagacagggggacatcaacgcctccgatttcctggctcttgtggagaaattcaacctggacataagcaaagaggagtgtcagcagctcattataaaatacgacttaaagagcaacgggaaatttgcatactgtgacttcattcagagctgtgtcctcctgctaaaagcaaaggaaagctcactgatgcacaggatgaagatccagaatgcacacaagatgaaagaagccggcgcggagacgccatctttttactctgctctgctgcgtattcagcccaaaattgtgcactgctggaggccaatgcggcgcacgttcaaaagctatgatgaggctggaacagggctgctaagcgtcgcagatttcaggacggtcctgagacagtacagcatcaacctctctgaggaagagttcttccatattctggagtattacgataagacgctgtcttcaaaaatctcctacaacgacttcctccgggcattcctccagtagacacccctgctgtgtgcccagcgggacgacagccacagggcctgtttcaaggctaataaaatcctataatttgggggtttcatgaattttcaaaaaaaacaaaactcaa

SEQ ID NO: 129175 - DNA, 1129 bp, Homo sapiens
  Payload ID: 5270
  Gene Symbol: EFCAB6
  Gene Name: EF-hand calcium binding domain 6
  ENST ID: ENST00000356087
  CDS Start-End: 389-991
agtcagcgactgccgtcgtctctcgggcaacagcgtcctagagacgccgaatgggcagcccctctgagaccccgcggcttggggtccgcgcacgcgggtgccggcccagctaggcggagaatcgaggaggggttcccgggctcatcgcagaggattggaagggcctagattactgcccaatgacaaaagtgtgggcttaatgtcctcactcttcagggagagaatgtggactttagcatttgaactgaatatttgagattgaagatttctgaataggatttaatgtgcaaaatggcgattataccagactggcttaggtcgcatcctcacacacgaaaatttacacattcaagaccccattcttcaccgtgtagagtatattcaaggaatggttccccaaataagttcagatcttcttcaaatcccccttagcacctctggtactgtaccgtaccttgcctttctgtccaggtttggtggaattgacctatatataaatggtataaagaggggaggtgggaatgaaatgaattgctgccgcacattaagagaacttgaaatccaagtgggagaaaaggttttcaaaaacattaagactgttatgaaagcctttgagctcattgatgttaacaagactggactggttcgaccgcaggagctaagaagggttctggagaccttctgtatgaagttaagagacgaggaatacgaaaagttttcgaaacactacaacatccacaaggatactgcagtagattacaacgtgtttttgaagaatctcagcataaataacgacttgaaccttagatattgtatgggaaatcaagaggtctcgttggagaatcaacaagccaaaaattccaaaaaggaacgtttgctaggttctgcatcatctgaagatatctggagaaactactccttggatgaaattgagaggaacttttgtctacaagtaagatgttttcctaagccacaattacctacagagtaaacacagcaaagtagacaatatggaaaactattaggtttacacattatttctaaaatttgtttcgatcctacctatgtcttctccaatactgagaccccctctacctcccaataacagcaatacattgatcatggataa

SEQ ID NO: 129176 - DNA, 4424 bp, Homo sapiens
  Payload ID: 5270
  Gene Symbol: EFCAB6
  Gene Name: EF-hand calcium binding domain 6
  Uniprot ID: Q5THR3
  ENST ID: ENST00000396231
  CDS Start-End: 266-4315
ggagaatcgaggaggggttcccgggctcatcgcagaggattggaagggcctagattactgcccaatgacaaaagtgtgggcttaatgtcctcactcttcagggagagaatgtggactttagcatttgaactgaatatttgagattgaagatttctgaataatcccccttagcacctctggtactgtaccgtaccttgcctttctgtccaggtttggtggaattgacctatatataaatggtataaagaggggaggtgggaatgaaatgaattgctgccgcacattaagagaacttgaaatccaagtgggagaaaaggttttcaaaaacattaagactgttatgaaagcctttgagctcattgatgttaacaagactggactggttcgaccgcaggagctaagaagggttctggagaccttctgtatgaagttaagagacgaggaatacgaaaagttttcgaaacactacaacatccacaaggatactgcagtagattacaacgtgtttttgaagaatctcagcataaataacgacttgaaccttagatattgtatgggaaatcaagaggtctcgttggagaatcaacaagccaaaaattccaaaaaggaacgtttgctaggttctgcatcatctgaagatatctggagaaactactccttggatgaaattgagaggaacttttgtctacaactttcgaagtcttatgaaaaggttgaaaaggccctcagtgcaggggacccctgtaaaggtggctacgtgtcttttaattatctaaagattgtcctcgacacttttgtataccaaataccaagaagaatttttatccagttaatgaaaagatttggacttaaagccaccactaaaatcaattggaagcaatttctaacatcatttcatgagcctcaggggttgcaagttagcagtaaaggtcccctgacaaaaagaaatagcatcaactctagaaatgaatctcacaaggaaaacatcatcacaaagttatttagacacactgaagatcactctgcgtcactgaagaaagcattactgataatcaacactaaacccgatggaccgataacaagagaagaatttcgatatattctaaattgcatggctgtaaaactaagcgattcagaattcaaagaactaatgcaaatgcttgaccctggggacactggagtggtcaacaccagcatgtttattgatctgattgaagagaactgtaggatgagaaagacatctccctgtacagatgctaagacacctttcctcctggcctgggattcagtggaagaaattgttcatgatacaattactaggaacctacaagctttttataacatgctacgctcatatgaccttggagacacagggcgcattggccgaaataatttcaagaaaatcatgcacgtcttctgtccatttttaacgaatgcacatttcataaaactctgcagtaagattcaggacattggttcaggaagaatcctttacaagaaacttttggcatgcataggaattgatggcccacccactgtctctccagttcttgttccaaaggatcagctgttaagtgaacatttacaaaaagatgaacagcagcagccagatctttctgagagaaccaagctcacggaggataaaaccaccctgaccaagaagatgaccacagaagaagtgattgaaaaattcaaaaagtgtatacagcagcaggacccggcattcaaaaaacgatttcttgacttcagcaaggagcctaatggaaaaattaacgtgcatgactttaagaaggtactggaagacactgggatgcccatggacgatgatcagtatgccctgctgaccactaaaataggcttcgagaaggaagggatgagctatcttgattttgcagcaggatttgaagatcctccaatgagagggccggaaaccactccgccgcagcctccaactccttcaaaaagttacgtgaacagccactttatcaccgcagaagaatgcctgaagcttttccctaggaggctgaaggagtcattccgggacccctactctgccttctttaaaacagatgctgacagggatggcataatcaacatgcatgaccttcacagactgctcctgcatctactgcttaatctcaaagacgacgagtttgagcgcttccttggccttcttggcttgagacttagtgtcactttaaattttcgggaatttcaaaatttgtgtgagaagagaccatggagaacagatgaagcgcctcaaagactcattagaccaaaacagaaggttgcggattcagaactagcttgtgagcaggctcatcagtatcttgttaccaaagcaaaaaacagatggtcagacttgtctaagaattttctagaaaccgataatgagggcaatggcattcttcgacgccgggacataaagaacgcactgtacggttttgatattcccctcacaccaagagagtttgaaaagctttgggcaagatacgacaccgagggaaaagggcacattacttaccaggaatttttacagaaattgggtattaactattcgcctgctgtccatcggccctgtgcagaggattatttcaacttcatgggtcattttacaaagccacagcagctacaggaagagatgaaggagctgcagcagagcacagagaaggctgtggcagccagggataagcttatggaccgccatcaagatatcagcaaagcattcaccaaaactgatcaatccaaaaccaactacatatccatatgcaagatgcaggaagtgctggaagaatgtggatgttctcttaccgaaggggagctgacccatctgctaaacagttggggagtcagccggcatgataatgctatcaattacctcgacttcctgagagcagtggagaacagcaagtcaacaggagctcagcccaaggaaaaagaagagagcatgccaatcaattttgcaacgctgaatccacaggaggctgtgaggaagatccaggaagtagttgagtcctcccagctggctttgtccacggcattttctgcattggataaagaggatacaggatttgtaaaggctacagaattcggacaagttcttaaggatttctgttacaaactaacggacaatcagtatcattattttttgaggaaactaagaattcatctaaccccctatataaattggaaatattttctccagaactttagctgtttccttgaggagacagctgatgagtgggctgagaaaatgcccaaaggcccgccgcctacctctcccaaggccacagccgacagagacatcctggctcgcctccacaaagcagtgacttcccattaccatgccatcacccaggagtttgagaattttgacaccatgaaaacgaacaccatctccagagaggagtttagggccatttgtaatcgccgcgtccaaatcctgacggacgaacagtttgacagactctggaacgagatgccagtcaatgccaaggggaggctgaaatacccggacttcctgagcaggttcagttccgagacagcagccacaccaatggccactggtgactcggccgtggcccagagagggagcagtgtccctgacgtctcggaaggcaccagatctgccctctcattgcccactcaggagctgagaccagggtcaaagtcgcagagccacccctgtactccagcgagcaccaccgtgatcccgggcactccacccttgcagaactgtgatcccatagagagcaggctccggaagagaatccagggctgctggcgccagctcctgaaagaatgcaaggagaaggacgtggccagacagggggacatcaacgcctccgatttcctggctcttgtggagaaattcaacctggacataagcaaagaggagtgtcagcagctcattataaaatacgacttaaagagcaacgggaaatttgcatactgtgacttcattcagagctgtgtcctcctgctaaaagcaaaggaaagctcactgatgcacaggatgaagatccagaatgcacacaagatgaaagaagccggcgcggagacgccatctttttactctgctctgctgcgtattcagcccaaaattgtgcactgctggaggccaatgcggcgcacgttcaaaagctatgatgaggctggaacagggctgctaagcgtcgcagatttcaggacggtcctgagacagtacagcatcaacctctctgaggaagagttcttccatattctggagtattacgataagacgctgtcttcaaaaatctcctacaacgacttcctccgggcattcctccagtagacacccctgctgtgtgcccagcgggacgacagccacagggcctgtttcaaggctaataaaatcctataatttgggggtttcatgaattttcaaaaaaaacaaaactcaa

SEQ ID NO: 129177 - DNA, 2313 bp, Homo sapiens
  Payload ID: 5271
  Gene Symbol: EFCAB7
  Gene Name: EF-hand calcium binding domain 7
  Uniprot ID: A8K855
  ENST ID: ENST00000371088
  CDS Start-End: 247-2136
actctggccataccacccccgcgatagaggagcaacacagctgtctctgtgcgctccggatcagcgcttcctagatttctagccggatcgtttggagaagggctctgcatcttatttccggtggcggtgaggtgcagttgccatggtgattagagaaaggccgagatctgtccagctgcggtgagaggaacgctgaatcgccgaagagaattggctgcgcttccttgtttgtgagctagaattagaatggcgatcagtccacgaagcgatgcaactttctccagtcagaaatcaacaccttcagagagtcctcgaacaaagaaatttccactaactgaagaggaaatattttatatgaattgtagagctgcctacttaactgtcttcaaaagcagcttggaaaacattatttctaaagatcaactttacttagctcttcagcatgcaggaagaaatccatcccaaaagaccattaataagtattggactcctcaaactgccaaactgaattttgatgatttttgtataattttaaggaaggaaaaacctacttcaaaagcagaactactaaaatcatttaagcaattagatgtaaatgatgatggctgtattttacacactgacctttataaatttctaacaaagagaggtgagaagatgactcgagaagaagtaaatgccataataaatttggctgatgtaaatgctgatggcaaatttgactacatcaagttttgtaaattatatatgacaaccaacgagcaatgtctcaagactacactagaaaaactagaggttgacagtaaattgatgcgtcaccagtttggaaaccacatcgaagggtcccctgaaagggacccatcaccagtaccaaaaccatcacctaaaatcacaagaaaaactgatccagaaacattcttaaataaaggtgacaccaggagttctttactgtcagcaaccaggaagttcaaaacatctgtttccttcacagttaccatgggggctaatggtaaccgaaactcaaagttaatggagccaaatttaataaaggactggcaacacatgcaatcaaaaggttgcttcttcttagaagaagatggtgaaatcattagtcatcagtacaggatgcaaatagctcagaggtccatggtttatctaacaattaagccattaaacctgagtcaagttgaaggaaaaccatccccttggttatccgttgatactgccttgtatattctcaaggaaaatgagagtcaagcaaatctacagcttgtgtgttttaccgaactacgaaatagagaagtgtttggatggactggtgaactaggacctggaatttactggttaattccttccacaactggctgtaggctgaggaaaaaaataaaaccagtaacagatgaagcccaacttgtatatagagatgaaacaggggaattattccttacaaaggaatttaagtctactttatcagatatatttgaagtaattgatttagatggaaatggtcttcttagccttgaagaatataatttttttgaattgagaacaagtggtgagaaatgtgatgaagatgcttgggctgtctgcagagagaattttgatacaaagaggaatgaactaacaagacaaggatttatggatttgaatctaatggaagctaatgatcgagaaggagatccttgtgacctttgggtaactctacactctatgggctacaataaagctctggagttgacagaggcatgtccatttgtcattgatatctatgcagaaaaatgcaagccaaaaattaaagctgtccatatggaggcatgtagtggacaacttgagaaggccatttgtaaatctgttcttagcaacggtgatgccaaagtaatggatggctatgaaaatataatcgtgcatacttacagttgtgacacctggataacgtcagttattgaaaacaagtcagatgagaaagtgattattcacatcagcaatgagctaagtaaaaactgcataaacaacagaggactcaacatatttgcagtagaagtgggacccaaatctacaatggtttgtcaacatgtaatgcctttgaatgaacgacaagaatggatatattattgtatatattctcttatttcttaaataattatacttagaacttaccaaactaagaattatttcagatttagtctgttatttattaaacaactaaatgctacttaactgatgtacctaaataataatctattcaatttatatgcattttcattttatgtccatggtatgtactttattattaaaatataaataatgctttca

SEQ ID NO: 129178 - DNA, 3961 bp, Homo sapiens
  Payload ID: 5272
  Gene Symbol: EFCAB8
  Gene Name: EF-hand calcium binding domain 8
  ENST ID: ENST00000400522
  CDS Start-End: 95-3961
tttgttgagatgggagttggaaagtgttagcactttgccagactttgccagcaagattaactgaggagatcaaattgagtcagggtcaaggctaatgtcttctgaagacttagcagagatccctcaactccaaaagctgtccatcccacatggcttccagaacaaggaggctgctagctccccaacaccatccatcacccttagccaggtgcctgacctccagcctgggtcccagctgtttactgagatacacctggccaagatagagaaaatgtttgaggaggacatcaactcgactggagccctgggcatggacgccttcatcaaggccatgaagaaggttctgagcagtgtgtcggacgagatgctaaaggagctgtttttgaaggtggactcggactgtgaaggctttgtcacctggcaaaagtatgtggattacatgatgcgtgagttccagggaaaagaggacatgcgaaagagccagtaccgcctgcacttctaccttcccatgacggtcgtccccctgaaccatggctgtgaggtggtgaaggtggtgtttttaatccaccggttcaagaagatcgggtgtttcctgactgtcaccaaagacgggatcctgcagttctggtctgagtccttctcgctgatgagctcctttaggcttaaccagacccagcagctctacaaccagccgatgtgggtcattgacatggtatgtctgcacaatatgaacctcgttgcagttgcgtctaccaggcaaaagatagatttctttgatattagtgaccacaaatgtgtccgggccttcacctttgttgatctggacagctgtgctctggtcatggactactggtctgactatcacagaggtgtgttctgctatggagacgccaaaggcaacgtcattgtcttcacctccgaaaacatgaccagtgggctgttcaacccccgtatcctccccagggcctccaagtgggatcactggatcaaagtttccttgcagaaactcttaaatgagaagtctgctttgcatagaagctaccggctgaaggctctccatcccaactggtgtgagcaggtcaagttcatcccccagatgaatgtggtagtctcctgttcagccatcgagaagtcctctctggtgctgacaatattgccagccaaagcctctaagaaacccaggttgtcagtgctgcgtttaaggaaagggattctttgctttgattactgcccagacaggaacttcctggtgactggtggctacgatgccttcatccgcctgtggaacccctttgtctcaaagaggcccgtgtggctgatgaagggacaccagacctcagtgacgcacatccttgtggatagcaggaacaacagcatcctcatcagtgtctccaaggacaagaatattcgcgtgtgggacatgctggactacatatgcctccagtccttctgtgggaagttttttgctctgggaaactgccccatcaccagtgcctacttcttcgagaaggacaataccctcatctgcagcacctactcaatcgggatcctaaaagggtacttagaggcccaggggcttatcaaagcaaggaagaggaccactcattgctcacccctgtgtgctgtcctctacagcaagatctttaagcaggtggtgagtggctgcctgcgcggcacagtgagtgtgtgggaggtcgtgacgggcaggaagacgatggagtttgctgtgtctgggggccagcacgtggagatgaccgccatggccctggatgagtcagagcggtgcctgctcacaggtttgcgggatggcacaatgaagatgtggaactacaacattggcaaatgcctgttgacctttcccagtccggaacagctggagattagtgggattatccatatgaacaaagtgttctatgtgacaggatggagtaagagaatcactcatttcctgttccacaagaccaagccagtgctcttgtgctaccactggcagacctaccacacggaggacatcctgagcatggccaagtaccggaaccagttccttgggacctcctcctacagtggggacatcctcttctggaacaccggcacactcaagcccatcttcaacttcaatgcctctaggagcccctcgcccttgcagcccaagagggtgcaagatgtgaacaactgcctggctgagagccacaggcccagcagaccctatgtggagcgggagaagtggacatacaagacctccaggaagctctccagtctcagccccgagtctgtggccaataccaacctgaggcggagcctggtgtcggctcccccagtgatgcggtgcccgagagacaaggagccagacaggcctgtgccccagcagaaaccttccagtgcttctggcacatccaggcagtcaagcaagatccacagcaaacagtccatttacaaagaggatgaaacgagaaaaggagaatggcagaagaatatgttggttcaatccagtgcctcggtggagaagataatcttcctgcagaccaggcctcgcctgccgcacacggctgccctgctgagcagctgcatggacggctacatctacgcctggtccctccatgagaatggaggcctgctggggaagttccctgtggacctagacaatggggatgttgtcgtgggtgccatggccactgataaaaatgactggatcctcatcacgggggattgtaaaggatacatcaagatctgggacatcaaggattactgcgcattgattgataaacagccattccaatccagtggggccaaggttgtctctgaagcacacaacaagttccggttgttaattcctcagcaacttgggaccaacttcccacactacattcccttggaggataaagaggttgtggctggccataccatttccctggttccccccacgctcctgatgacctggaaaggccatttgaatagtgtggcagacatcctgtatgtggacaacttccagctggttatcagcgctggccaggaccgggacgtcaaggcttggaaactctccggtgatgccattggaacgtttggcctgagtgtgtggaaaagactacaggatgcctgtgatggtcctcgtgaaaacagagcaagcttagaggaagatggtgactccactggcaccacccagaaggtcttacatctggagctgcaggagcagcgggatctggctgaggccctgatataccagcggcgagagcaggcggcgctgatggctctcctgcatgggaaggcagataaggaggcagacacttgggccaagctgcagaagatggccctgatgtccccgtgggccggagagcgccccctggaagacattgaggacagctggaacaagtgggagtccagggacaagcaggtgagcaaagtcttgggagcggcgtataagcccaaggaacgcttgcagaataccaggttcctgtccaccagggtgccatatggctggatgaagcatcagatctcgcctcaggtctaccaaagcctgcacttcagtgatctgatgccgactcagcagcctgacttcctgaccagcaggggcccagaccagcaagaccagcacatccgcctggtggcccaccatgtccagaaggacctggtgcccagcagggagcaggctgtgctggataccacggacagcacgcctgcggccgcctcctccccatcttccttgttatctgtcactgcctcagcctccaggctgctggactccagcttgcccaccttcctgacgccccagttctccttcttgctgcggccccagtcagcctccacagcccattccaccccctcggtcccatccccggtgtccaagtccaccctgcaggggtcagtgacccccaagcacattgtctcctccttcgagcggcccccaaggcctctgaaggccaccttcatgtcctctgtgaaggggagctcccatgtcaggttctga

SEQ ID NO: 129179 - DNA, 435 bp, Homo sapiens
  Payload ID: 5272
  Gene Symbol: EFCAB8
  Gene Name: EF-hand calcium binding domain 8
  Uniprot ID: A8MWE9
  ENST ID: ENST00000618684
  CDS Start-End: 1-435
atgtcttctgaagacttagcagagatccctcaactccaaaagctgtccatcccacatggcttccagaacaaggaggctgctagctccccaacaccatccatcacccttagccaggtgcctgacctccagcctgggtcccagctgtttactgagatacacctggccaagatagagaaaatgtttgaggaggacatcaactcgactggagccctgggcatggacgccttcatcaaggccatgaagaaggttctgagcagtgtgtcggacgagatgctaaaggagctgtttttgaaggtggactcggactgtgaaggctttgtcacctggcaaaagtatgtggattacatgatgcgtgagttccagggaaaagaggacatgcgaaagagccagtaccgcctgcacttctaccttcccatgacggtcgtccccctgtaa

SEQ ID NO: 129180 - DNA, 702 bp, Homo sapiens
  Payload ID: 5273
  Gene Symbol: EFCAB9
  Gene Name: EF-hand calcium binding domain 9
  Uniprot ID: A8MZ26
  ENST ID: ENST00000398186
  CDS Start-End: 2-595
gatgagactgaagcaaggatcgtttctgtggtacctctatctggacaaaatatactgcttattatccgtgagaaacgtgaaggctttggcagaatattttcatattctggacgtgcacggcaagaacaccttgaatgatgtgctgttctatcacttccttcatcatgtgactgacttgaaaaaggcacagatcaacattgtgtttgacatgctggactggaacgctgtgggcgagatcgactttgagaagttctacatgctggtgtgcatgctgctggcccaccagaaccatttggaaggacagtttatgtatcgtcattcccggcctgtctttgacctgcttgacctgaaaggggatctgagaattggtgcaaaaaacttcgaaatgtacagatttctcttcaatattcaaaaacaggaactcaaagatctcttccgtgactttgacattacaggtgacaatcgtcttaattatcaggaatttaagctgtatacaatcatctacactgacaaattacagaagaggcagaaaacagaggagaaagaaaaaggagagagaaagagaagtctctactcaaaatgtcacatcaagtagatacaagctgaaagagtcttggaaaaaaatgggatctgaaagtacagaacatgaacattgatgaagactgttaacatgtctaaaaataaattcagagcatcaaagta

SEQ ID NO: 129181 - DNA, 5470 bp, Homo sapiens
  Payload ID: 5274
  Gene Symbol: EFHC1
  Gene Name: EF-hand domain (C-terminal) containing 1
  Uniprot ID: Q5JVL4
  ENST ID: ENST00000371068
  CDS Start-End: 104-2026
agcgttaccatggatcctggaggtgcccgcgaacactgcttgtcgcctgggcaaccggagaggacgaagcaggacctaggtggcggcggtggtaccggctgcaatggtgtccaatcccgtgcatggcttgccctttcttccgggcacgtcctttaaggactctacgaaaacagccttccacagaagtcagacgctgagctacaggaacggctatgcaattgttcgacgtccaacagttgggataggcggagaccggctccagttcaaccagctgtcccaggctgagctggatgagttggccagtaaggcaccagtcttaacttatggccaacctaaacaagccccacctgcggattttattcctgcgcatgtggcctttgacaaaaaggtactgaaatttgatgcctatttccaagaagatgttcctatgtcaactgaggaacagtataggatccgtcaggtgaacatttactattatctagaagatgacagcatgtctgtcatagagcctgttgtagaaaattctggaatccttcaaggcaagttaataaaacgccagcggctagccaagaatgaccggggtgaccattaccattggaaagacctaaatcgaggaataaacatcacaatttatggcaaaactttccgcgttgttgactgtgaccaattcacacaggtatttttagaaagccaaggaattgagttaaatccaccagagaagatggctcttgatccttacactgaactccgaaaacagcctcttcgtaagtatgtcaccccatcagactttgatcaactcaagcaatttctcacctttgacaaacaggtccttcgattctatgcaatctgggatgatacagacagcatgtatggtgaatgtcggacctacatcattcattactatcttatggatgatacggtggaaattcgagaggtccacgaacggaatgatgggagagatcctttcccactcctaatgaaccgccagcgtgtgcccaaagttttggtggaaaatgcaaagaacttccctcagtgtgtgctagaaatctctgaccaagaagtgttggaatggtatactgctaaagacttcattgttgggaagtcactcactatccttgggagaactttcttcatttatgattgtgatccatttactcgacggtattacaaagagaagtttggaatcactgatttaccacgtattgatgtgagcaagcgggaaccacctccagtaaaacaggagttgcctccttataacggttttggactagtggaagattctgctcagaattgttttgctctcattccaaaagctccaaaaaaagacgttattaaaatgctggtgaatgataacaaggtgcttcgttatttggctgtactggaatcccccatcccagaagacaaagaccgcagatttgtcttctcttactttctagctaccgacatgatcagtatctttgagcctcctgttcgcaattctggtatcattgggggcaagtaccttggcaggactaaagttgttaaaccatactctacagtggacaaccctgtctactatggccccagtgacttcttcattggtgctgtgattgaagtgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaagcaagcaaactgaaaaggatccaggcgtgcaggaattggaagcattaatagacacaattcagaagcaactgaaagatcactcatgcaaagacaacattcgtgaggcatttcaaatttatgacaaggaagcttcaggatatgtggacagagacatgttctttaaaatctgtgaatcgcttaacgtcccagtggatgactccttggttaaggagttaatcaggatgtgctctcatggagaaggcaaaattaactactataactttgttcgtgctttctcaaactgacctgctgatgagaaaatgcaagacaatttttgatactggaactatgctttgaaatacaccttacactcttcatagaggcatttacagggttcctgaagttttatttctgttttggttcttctttcactcctactgaagtcgaaactaaattggatctaataggatctaagattggtgccttatttagggtgataggggtatagcaatgtctaattttgtgtgtcaaattgacttggccacagggggcccaaatatttcctttctttctttttaaaaaaataaatttttttagagatgggatctcactctgtcatacaggctggagtgtggtggcactatcctagttctatgaagcctcagactcctgggctcaagtgatcctcccacttcaacctccccagtagctgggacaacaggctcaagccaccatgcccagctaatttttaaaattattttgtagagacaaggtcttgctaggttgcctgaacttgtctcaaactcatgagctccagaaattctcccacctcagcctccaaaagtgctgggattataggcatgagccactgtgcccagcctcagatatttcattattctgggggtttctctgaaggtatttttcgatgagataaacatttgaatcagaagactaagtaaaacagatagtcctccctaatgtgggtgggcctcctccaatcatttgaagacatgagtagaataaaaaggctgacctttccccaggtaagagaattcctcctgcctgactggcttcaaattggaacatcagccttttcttgccttcagacacaaatggaaacatcagctgttggtctggagcctgctgaccttcagactggacctaaaccatcagctctcctaagtcataggcctttggattcagactggaattatacctttagctctcctgggtctccagcttgccaatttaccctgcagatcttgggacttgtaagccttcataattgtgtgagcaatttcttataactctctctttctctctctctacatatatatatatatatatattttatatgtacacattcatacacacacacgcttatatgtatacatatagtatgtatatgtgtatatatattatgtatatacatatatgtgcacacatctctactaaaaatagaaaaattagccaggtgtggtggcgtgtgcctgtagtcccagccactcgggaggcttaaatgggagaatcacttgaaccctggaggcagaggttgcagtgagccaagaccacgccactgcactccatccagcctgggtgacagagcaagactccatctcaaaaaaaaaaaggttagaaaaatgctgcttttagagagcctggccttgagagaggaaggaaagactagttgcagttactattctctggtgagctctgactggctttttacaaacagggcttctctttggttgaagtcagccactaagttcatctttaaacatgctatctcaaattccccgaagccacccaaaatgtggtatgaatgaggatagagttacacagaattcagactgctttgccctctcagaacttctagggaacttcccttggtgtttccttccctaacgagctcagccacttgtaaccagcttattgaaagggctgtgaatgtattatgttgattccttttctgttccaggttattatcttgggaataacccatgttttgttttgttttaccctcagtcgctcataactatttaaaacagtatctctttcaagtacagatgctcctctacttatggggctatgtctcaataaactcacgtaagtaaaaaatatcacaagttgaaaacacatttaataaccctgataagcccattgtaaagtaggcaaataagttggaccattgaaagttggggactatctgtattttagaagttttttcagcttaaaaattaccaagctctatcctacttggcccagctcagtccttcccccaggcttagaagcctgtggtaaagagtgtgtgtatactggggtgatgatagtggtttcttcttactcccttctttctgtcttctgctccctttgttcctattcagccatgctgctgtttctagcccatgtaggctctgggaaaggttaagcgggtagaaaccagagaaaaagggcaaagtcttatttctgtggctagtaatgtcgtaatgtggggccaggtctgagtgacatgtgccgaaaggctgactctttctcccagagcaccttttctctctttttggattcagggggtacatgtgcaggtttgttacatgagtatattgcacccaggtagtgagcatagtgcccagtaagtagtttttccacacataccccctccttcccttcccactctggtagtccccagtgtctattgttcccatcattatgtctatgtgtattcaatgtttagctcccacttagaagtaagaacatgcaatatttggtttcctattcctgcatcaattcactttaggataatggcctccagctgcatccatgttgctgcagaatacatgatttcattttttatggctgcgtagtattccatggtgtagatatacttcatttaaaaaatctaatccaccattgattggcacctaggttgattccatgtcctttgctcagagccccgttttggtgagttcttagaactctttccaaccggaaactgcccagtgcaccactctcagatggacgggacccagtctgtacctgatcaccccggctctaatggtatggtctccaaggctccttctgatcttcccaggaggccctttcaggctgacacaccttccagggtgtgcactctcgccatgttctcacccagatggctctcttggctgtgtaattaggcagctcaatccctttcctttagactgtttcaggggagaaccaggtaccccaaatcttatgctctccaaactccaggggacagacacatgtcaaaccctgagtcttttaaagtataccctcacttagcttgcagacccaaggcactccagcccctttcaagaagcttgcactttctgatattttctccatcactcttgcctcctgtggtagaggagctttgggctactccttaacaaatcattcatggatcggcagcaaatctgcaacatatggatatatttgccaatttttgtcctcagctttgggtctcagccaaaatggagatttaggaaagtctcatttagcatcctctagcctgcttttggctgttttgttttgtttttgtgtttgttttttagagacagggtcttactctgttgccagactggaatgcggtggtgtgaccatagctcactgcagcctcaaactcctgggctcatgcaatcctcctgcctcagccttctgagtagctaggcctgtagtctcagagggaactgtcttcaataaagttggcactgtccacatacactccttaa

SEQ ID NO: 129182 - DNA, 3442 bp, Homo sapiens
  Payload ID: 5274
  Gene Symbol: EFHC1
  Gene Name: EF-hand domain (C-terminal) containing 1
  Uniprot ID: Q5JVL4
  ENST ID: ENST00000480623
  CDS Start-End: 104-940
agcgttaccatggatcctggaggtgcccgcgaacactgcttgtcgcctgggcaaccggagaggacgaagcaggacctaggtggcggcggtggtaccggctgcaatggtgtccaatcccgtgcatggcttgccctttcttccgggcacgtcctttaaggactctacgaaaacagccttccacagaagtcagacgctgagctacaggaacggctatgcaattgttcgacgtccaacagttgggataggcggagaccggctccagttcaaccagctgtcccaggctgagctggatgagttggccagtaaggcaccagtcttaacttatggccaacctaaacaagccccacctgcggattttattcctgcgcatgtggcctttgacaaaaaggtactgaaatttgatgcctatttccaagaagatgttcctatgtcaactgaggaacagtataggatccgtcaggtgaacatttactattatctagaagatgacagcatgtctgtcatagagcctgttgtagaaaattctggaatccttcaaggcaagttaataaaacgccagcggctagccaagaatgaccggggtgaccattaccattggaaagacctaaatcgaggaataaacatcacaatttatggcaaaactttccgcgttgttgactgtgaccaattcacacaggtatttttagaaagccaaggaattgagttaaatccaccagagaagatggctcttgatccttacactgaactccgaaaacagcctcttcgtaagtatgtcaccccatcagactttgatcaactcaagcaatttctcacctttgacaaacaggtaagtgacataggaaccacaataggcttacttatttccaaatgtgacctacatttattggcaaaaggtttgggtagctgtattggtaactattttgaaacattacagctataattgaactgtttggacacagtactgtctttctgctttcatcaagggttacaggtacaggaatgcctacatttcatatggagatccaaagaagatcgtggagttgcggagttgttttgtgaacctcaccaaacatttaaatctcaaagcaattcctgagctacatctgcttcccaccttacgtttccaattgacaatttctttcccttaaaatgagctaatttcatagactcctttgtgaaaccataaatcgattattaggaaatttcacaaatatgcatacatgtaggttgtaatgttaaaatgtttaatttcacagaagccccactacagatgcttccttgttaaatgttatattaatattggagtccagaatgttctgagcattttccaactctgttccaaccttcctaatcctctcccttgtgagctgatgtgtataagcagatttaaatccttccctttctgtactaaagggagaaagaaaaggaagagatcaccctcagtgcttctttgctgctccttttctttagacatttaaccccttttagttcagaaaatgtaaactagcactagcatggtcttttaaggattttgttcatatcagtcatatatctgttattattttgtatttaaagattgtgtttattcccacgatttgaagaagcctagccaaaaaaaaaaaaaaaaagattgtgtttatattattgctagaagatatgtgttgatgggaccaaaaaaagactggttaataaataaaaattttttctacactaattatatataaaccatattcacatgtacctttattaatatatatataccactatgtaaagaacttcattgctcttttaatttagcttctctttcactgactaatattttggatcaaagtgagctcttcttttttggcacaaacttataatcctattatttaattctttccagctgctgacatatagtacataatttcagatgttttagtatgtttgatgaatatttctttttttttcaatttaccccatctgaaattacttcatagtctttccagctagtctttccatcgttgatacataattgccaaagtagccaagttgaactccctacttttaggattcttgagtcactactttggattcttcaaaggtccttcgattctatgcaatctgggatgatacagacagcatgtatggtgaatgtcggacctacatcattcattactatcttatggatgatacggtggaaattcgagaggtccacgaacggaatgatgggagagatcctttcccactcctaatgaaccgccagcgtgtgcccaaagttttggtggaaaatgcaaagaacttccctcagtgtgtgctagaaatctctgaccaagaagtgttggaatggtatactgctaaagacttcattgttgggaagtcactcactatccttgggagaactttcttcatttatgattgtgatccatttactcgacggtattacaaagagaagtttggaatcactgatttaccacgtattgatgtgagcaagcgggaaccacctccagtaaaacaggagttgcctccttataacggttttggactagtggaagattctgctcagaattgttttgctctcattccaaaagctccaaaaaaagacgttattaaaatgctggtgaatgataacaaggtgcttcgttatttggctgtactggaatcccccatcccagaagacaaagaccgcagatttgtcttctcttactttctagctaccgacatgatcagtatctttgagcctcctgttcgcaattctggtatcattgggggcaagtaccttggcaggactaaagttgttaaaccatactctacagtggacaaccctgtctactatggccccagtgacttcttcattggtgctgtgattgaagtgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaagcaagcaaactgaaaaggatccaggcgtgcaggaattggaagcattaatagacacaattcagaagcaactgaaagatcactcatgcaaagacaacattcgtgaggcatttcaaatttatgacaaggaagcttcaggatatgtggacagagacatgttctttaaaatctgtgaatcgcttaacgtcccagtggatgactccttggttaaggagttaatcaggatgtgctctcatggagaaggcaaaattaactactataactttgttcgtgctttctcaaactgacctgctgatgagaaaatgcaagacaatttttgatactggaactatgctttgaaatacaccttacactcttcatagaggcatttacagggttcctgaagttttatttctgttttggttcttctttcactcctactgaagtcgaaactaaattggatctaa

SEQ ID NO: 129183 - DNA, 5308 bp, Homo sapiens
  Payload ID: 5274
  Gene Symbol: EFHC1
  Gene Name: EF-hand domain (C-terminal) containing 1
  Uniprot ID: Q5JVL4
  ENST ID: ENST00000538167
  CDS Start-End: 1-1866
atgttgaaaacagccttccacagaagtcagacgctgagctacaggaacggctatgcaattgttcgacgtccaacagttgggataggcggagaccggctccagttcaaccagctgtcccaggctgagctggatgagttggccagtaaggcaccagtcttaacttatggccaacctaaacaagccccacctgcggattttattcctgcgcatgtggcctttgacaaaaaggtactgaaatttgatgcctatttccaagaagatgttcctatgtcaactgaggaacagtataggatccgtcaggtgaacatttactattatctagaagatgacagcatgtctgtcatagagcctgttgtagaaaattctggaatccttcaaggcaagttaataaaacgccagcggctagccaagaatgaccggggtgaccattaccattggaaagacctaaatcgaggaataaacatcacaatttatggcaaaactttccgcgttgttgactgtgaccaattcacacaggtatttttagaaagccaaggaattgagttaaatccaccagagaagatggctcttgatccttacactgaactccgaaaacagcctcttcgtaagtatgtcaccccatcagactttgatcaactcaagcaatttctcacctttgacaaacaggtccttcgattctatgcaatctgggatgatacagacagcatgtatggtgaatgtcggacctacatcattcattactatcttatggatgatacggtggaaattcgagaggtccacgaacggaatgatgggagagatcctttcccactcctaatgaaccgccagcgtgtgcccaaagttttggtggaaaatgcaaagaacttccctcagtgtgtgctagaaatctctgaccaagaagtgttggaatggtatactgctaaagacttcattgttgggaagtcactcactatccttgggagaactttcttcatttatgattgtgatccatttactcgacggtattacaaagagaagtttggaatcactgatttaccacgtattgatgtgagcaagcgggaaccacctccagtaaaacaggagttgcctccttataacggttttggactagtggaagattctgctcagaattgttttgctctcattccaaaagctccaaaaaaagacgttattaaaatgctggtgaatgataacaaggtgcttcgttatttggctgtactggaatcccccatcccagaagacaaagaccgcagatttgtcttctcttactttctagctaccgacatgatcagtatctttgagcctcctgttcgcaattctggtatcattgggggcaagtaccttggcaggactaaagttgttaaaccatactctacagtggacaaccctgtctactatggccccagtgacttcttcattggtgctgtgattgaagtgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaagcaagcaaactgaaaaggatccaggcgtgcaggaattggaagcattaatagacacaattcagaagcaactgaaagatcactcatgcaaagacaacattcgtgaggcatttcaaatttatgacaaggaagcttcaggatatgtggacagagacatgttctttaaaatctgtgaatcgcttaacgtcccagtggatgactccttggttaaggagttaatcaggatgtgctctcatggagaaggcaaaattaactactataactttgttcgtgctttctcaaactgacctgctgatgagaaaatgcaagacaatttttgatactggaactatgctttgaaatacaccttacactcttcatagaggcatttacagggttcctgaagttttatttctgttttggttcttctttcactcctactgaagtcgaaactaaattggatctaataggatctaagattggtgccttatttagggtgataggggtatagcaatgtctaattttgtgtgtcaaattgacttggccacagggggcccaaatatttcctttctttctttttaaaaaaataaatttttttagagatgggatctcactctgtcatacaggctggagtgtggtggcactatcctagttctatgaagcctcagactcctgggctcaagtgatcctcccacttcaacctccccagtagctgggacaacaggctcaagccaccatgcccagctaatttttaaaattattttgtagagacaaggtcttgctaggttgcctgaacttgtctcaaactcatgagctccagaaattctcccacctcagcctccaaaagtgctgggattataggcatgagccactgtgcccagcctcagatatttcattattctgggggtttctctgaaggtatttttcgatgagataaacatttgaatcagaagactaagtaaaacagatagtcctccctaatgtgggtgggcctcctccaatcatttgaagacatgagtagaataaaaaggctgacctttccccaggtaagagaattcctcctgcctgactggcttcaaattggaacatcagccttttcttgccttcagacacaaatggaaacatcagctgttggtctggagcctgctgaccttcagactggacctaaaccatcagctctcctaagtcataggcctttggattcagactggaattatacctttagctctcctgggtctccagcttgccaatttaccctgcagatcttgggacttgtaagccttcataattgtgtgagcaatttcttataactctctctttctctctctctacatatatatatatatatatattttatatgtacacattcatacacacacacgcttatatgtatacatatagtatgtatatgtgtatatatattatgtatatacatatatgtgcacacatctctactaaaaatagaaaaattagccaggtgtggtggcgtgtgcctgtagtcccagccactcgggaggcttaaatgggagaatcacttgaaccctggaggcagaggttgcagtgagccaagaccacgccactgcactccatccagcctgggtgacagagcaagactccatctcaaaaaaaaaaaggttagaaaaatgctgcttttagagagcctggccttgagagaggaaggaaagactagttgcagttactattctctggtgagctctgactggctttttacaaacagggcttctctttggttgaagtcagccactaagttcatctttaaacatgctatctcaaattccccgaagccacccaaaatgtggtatgaatgaggatagagttacacagaattcagactgctttgccctctcagaacttctagggaacttcccttggtgtttccttccctaacgagctcagccacttgtaaccagcttattgaaagggctgtgaatgtattatgttgattccttttctgttccaggttattatcttgggaataacccatgttttgttttgttttaccctcagtcgctcataactatttaaaacagtatctctttcaagtacagatgctcctctacttatggggctatgtctcaataaactcacgtaagtaaaaaatatcacaagttgaaaacacatttaataaccctgataagcccattgtaaagtaggcaaataagttggaccattgaaagttggggactatctgtattttagaagttttttcagcttaaaaattaccaagctctatcctacttggcccagctcagtccttcccccaggcttagaagcctgtggtaaagagtgtgtgtatactggggtgatgatagtggtttcttcttactcccttctttctgtcttctgctccctttgttcctattcagccatgctgctgtttctagcccatgtaggctctgggaaaggttaagcgggtagaaaccagagaaaaagggcaaagtcttatttctgtggctagtaatgtcgtaatgtggggccaggtctgagtgacatgtgccgaaaggctgactctttctcccagagcaccttttctctctttttggattcagggggtacatgtgcaggtttgttacatgagtatattgcacccaggtagtgagcatagtgcccagtaagtagtttttccacacataccccctccttcccttcccactctggtagtccccagtgtctattgttcccatcattatgtctatgtgtattcaatgtttagctcccacttagaagtaagaacatgcaatatttggtttcctattcctgcatcaattcactttaggataatggcctccagctgcatccatgttgctgcagaatacatgatttcattttttatggctgcgtagtattccatggtgtagatatacttcatttaaaaaatctaatccaccattgattggcacctaggttgattccatgtcctttgctcagagccccgttttggtgagttcttagaactctttccaaccggaaactgcccagtgcaccactctcagatggacgggacccagtctgtacctgatcaccccggctctaatggtatggtctccaaggctccttctgatcttcccaggaggccctttcaggctgacacaccttccagggtgtgcactctcgccatgttctcacccagatggctctcttggctgtgtaattaggcagctcaatccctttcctttagactgtttcaggggagaaccaggtaccccaaatcttatgctctccaaactccaggggacagacacatgtcaaaccctgagtcttttaaagtataccctcacttagcttgcagacccaaggcactccagcccctttcaagaagcttgcactttctgatattttctccatcactcttgcctcctgtggtagaggagctttgggctactccttaacaaatcattcatggatcggcagcaaatctgcaacatatggatatatttgccaatttttgtcctcagctttgggtctcagccaaaatggagatttaggaaagtctcatttagcatcctctagcctgcttttggctgttttgttttgtttttgtgtttgttttttagagacagggtcttactctgttgccagactggaatgcggtggtgtgaccatagctcactgcagcctcaaactcctgggctcatgcaatcctcctgcctcagccttctgagtagctaggcctgtagtctcagagggaactgtcttcaataaagttggcactgtccacatacactcctt

SEQ ID NO: 129184 - DNA, 2464 bp, Homo sapiens
  Payload ID: 5275
  Gene Symbol: EFHC2
  Gene Name: EF-hand domain (C-terminal) containing 2
  Uniprot ID: Q5JST6
  ENST ID: ENST00000420999
  CDS Start-End: 85-2334
gggggccaaacaacacggccgggaggcgccgctgcctgccgggccctctcttctgggaccctggattttcggacactgagcgccatggccctgcctctgctgccgggcaacagcttcaaccgcaacgtgggaaaggagaagtttcacaaatcccaacattggggcttttgcaacaatgttatgatgttggtgagtgatgaaaagcctggaataggtggagaaccacttctggggcaaaagataaagcctaaatgtagcatatatcctaaaggagatggaagtgatgtaccatcatgggtagcctttgataaacaggtattatcttttgatgcctatttggaagaggaagtacttgataaaagccaaaccaactacagaataagatactataaaatctacttctaccctgaagatgacacaattcaagtaaatgaaccagaggtgaaaaatagtggattacttcaagggacttctatccggcgtcatcggattactcttccgcctcctgatgaggatcagttttatactgtgtatcattttaatgtcggcacagaggttgtcttctatggccggacattcaagatttatgactgtgatgcattcacaagaaactttttgaggaaaataggggtcaaagtgaatcccccagtgcaatgtccagaagatccttacatgaagattcggagagaggttgtagaacacgtagagcccttacgtccctacgaatccctcgacaccctgaaacagttcctccagtatcatggcaagattttgtgtttcttctgcctgtgggatgactcagtctcaatgtttggagaccgtagagaactcatcctgcattacttcttgtgtgatgatactattgaaatcaaagaattgcttccacacagctcaggccgagatgctctaaaaatgttcctccggaggagtaagctacccaagaattgcccacctagagtctatcaaccaggccagataacagatcgagcagttctcaattcatatggtgactttataaagaaccaagcggatggctacctgttcgatagatataagctaggaaaagtagaccaagagttttacaaagatagtgacctgtccctaggagtcaccatcaatgtgtggggaagaaaagtgctcctttatgactgtgatgaatttacgaagtcttattataagtctaaatatggaattgagaactttacctcagtttcatgcaagcctccttctcctcctccaaaaatagaaaggaaatttccaccttacaacggttttggttctgaagaggattctctccgtaactgcatagacctcaagcccacacctcatcggaggaacttcaagaagtttatggaaaaagacagctatggctccaaaagcaatatactccgtttttttgcaaaactagtcacagacaaatgtgttgacttggacaggatgtttgttatttcatattatctcggtgatgacaccatttcagtgtttgaacctatagagaggaattcaggaattgctggtgggatgttcttgaaaagaagtcgcgttaagaagcctggacaagaagtctttaaaagtgaactatctgaatatatcaaggccgaggagctgtacattggagtcacggtgaatgtgaatggttacctatttcgtttgctcaatgctgatgagtataccttaaactacatggagcagaatacagataagtatcctttcagtaacctcaaacttgccctacaaaagctgaagcaagaagaaggaaaatccagagagctcaagcaggtatttaaagctgctgactctaagcacacaaatatggtggattataatacattcagagacatattgatgtctttgactgttggaaaccttgcagagcaagaatttgtaaccattgcacgtcactaccgtgtgcctgagggcacatgttcagatatggatttcttaatcgcactggcccacgaaaagttcaagaaaaatatgtttgagaatttcgacactttcatttattcctgtgtgtatgaagatcgagaaaaaaaaaatgtattacccaccaaagacattaaaaggctgtgcaaatcctccagattacctttgagtgatgatcttctagaatccttattgtcaaggtttgaagacagtgaaaaacaaatagattataagtcatttttctctgccctgaactggagaaagaatccagtgcctgaattgcaaccagcatcataccttaaagagagatgtgaagatgtttggcttggtatgccatcacctattcctgcgaaatacattgactactggacctttttgaaggacgcgtttggcttagaggaggaataaccatgccagttttggtcaattctctatgatttacttctctcattttgccacatttactttagtagatataatttcattaaaaacaaaaaagaaacaaggtttatattaaatggaaatccataaaccacaa

SEQ ID NO: 129185 - DNA, 2823 bp, Homo sapiens
  Payload ID: 5276
  Gene Symbol: EFHB
  Gene Name: EF-hand domain family, member B
  Uniprot ID: Q8N7U6
  ENST ID: ENST00000295824
  CDS Start-End: 163-2664
taagaggcaggcaggaagcaatggacagggagtccgagtgaggttgtgctctttcctgagagaggggttccgcaagggattggaggcgtctttgtagccaggtacagctttccccttagagatgagcgctcttggagaaatgagaatggggagaaatcgtccatgaacatggagattggacatccccacgaaggaaaggatgatttaggagacaagagggtcatcatgggaacaaaatttcccatggagttggggatcagagtaggattaggaaaagaagattcccgatgcggggagagccctgtggttagtaataagtgtgagggaaggatggcaccaccagaaacaaaatttccattgagcaaggggcttgaaatgggattagaaagacagaatatttctaggactgtcatgcagaggggtagtttaggagtcgacagtgtctcagcttcacagggaacaaaaccttctctgttgccaggaagaatggggttagaaaatgagagtcttcttgcaggatatacccatgaacggataatacagcctcctttgggcagggtgtgtggaagttcacaggctgcagggagcaggagagctcctttggctagtggccctgaaggggtagaggaattagtgggaaagcctgctttcgttatggaaccaagacaggaaatggaaaaagagtctacctgtgttttaatgaaacccaacacagagattaagcttcctgtggaggtggacattggactaacccaagccgaggggccagatgagactaagaatacagagccccaaatgggcttggtgatagaacctccccaatgccagtttgcccaacaacatgaacagagaaaggaggctggaaacattgaatcaggagtggaacctccagatcgcatcagacccatatactctgggaagttttttgatcggaccccttgctggccaagtgcaggaaaagttattccagttggttacagagttgcaacctgcttgactgaaaaacttcccaggctaattactccacctgaagcaaaaaagtatttcaacttcagatatccacctgctggagtagaaagagtattttacggaagagcaaatgatccccagattgcaccttatttgacacatggaattagatctaaaatttcagtactggcaaacacattgataaacccacagcctattaccacatttcaacagaaaattaaagataaaaaagaatctatatatcttagcaatcgacgagcaccattaggaaaatctcacgatcaagcaccaggattaccaaaaggcatggacacaaccaatacgacatttgggacagcagtcatcaaagaatactctgctaaagatgtggtgaatccaccaaaatcctatgaagaagtatttaaagaaggaaatgaaggacatgatttgtatgttgtttctcacaatgattattatgcaggagaggcaaagaaccgaaagtataacccatcaagtttccataggtgtagtgtgtatggagtaccaacaccacattttaatgatggacgagccatggcaaaatctctatattggctccatgaactacaaatgaaaagaggagctaagtttgtatccaaaagagcagatgatttcaaagaaaagtttcaacataaacttggaagagttttagatcccattgcagaaacaatgaatgttcccccagactgcacatttggagcttgtctccgtcctgaggaatatggagttggtgatctcatccataatagacttccggatgaatatcttcgaggcaaggatagacagcgagccctgattgcagcagttcggcatcacctgaagaaagttaattaccaaaagtttgacactttgctggcagccttcaggcactatgacaagaagggagatgggatgatagataaagacgagctgcaggaagcttgtgaccaggccaacttgagtttagatgacaagctcctggaccagctatttgactactgtgatgtggataatgatggcttcattaactatctggaattcgcaaattttcttaactggaaagacaaaatgcttcttaaagagtatgaagagagggtcattattaaaggtagaaaaccagattgtgtaaaccctactgaggctaatgttgaagaacctgaacaaactctcctcataaagccagaagatattgtcttaaaagaagcaggaagcacagaaaagactctccggacacttctgagaccaagtgataaagtttccaactactataagacaacttcttctgagatcaatgcaattgtaggagccattccttctacttgttaccccatttgtggtgttccaaccattcgatctgacattcctgctccccgaattcgtcgcatcagtgacagaactaattatggtgaagaaggtagtgcatattcactactatatcctaccatttttgcccggaaaggagtgtttgaaagagacttcttcaagaccagatcaaaagaagagattgcagagatattgtgtaacattggtgtcaaactgtctgatgaagaatttgaaaatgtatggaatcttgcatcaaaaaagcatcacagaggagaagtttgtgttgagaacatcagaaatgttctagatgagctacggcatgcagaccggatcaagtgtaaaacactcatgtgatatttttggacttcattcattcaagcaaaagaattattaactctgtgtttatctaaaatgttgaatccattctggttttagatattatgttagagttcacagtggtaagactcatatgcctgtatgtgttgctaataaattagattttggattttaaaa

SEQ ID NO: 129186 - DNA, 2389 bp, Homo sapiens
  Payload ID: 5276
  Gene Symbol: EFHB
  Gene Name: EF-hand domain family, member B
  Uniprot ID: Q8N7U6
  ENST ID: ENST00000344838
  CDS Start-End: 123-2234
gttcgcggggcggggcgaggcaggatgtcacgtgaccctgcgagtggctcagatccgaactggccgcctttctccccttcccccaccccagtctgtcgcccaggctggcatgcaatggtgcaatgatggctcactgccgcatagacctcctgggctcaagtgatcctcccacttcagcctctcagatagctgagactacagatgtgagccaccacgctgggctaattgaattcttggcgttaagcaattcttctgccttggcttcccgaagtgttgagattacagagattaagcttcctgtggaggtggacattggactaacccaagccgaggggccagatgagactaagaatacagagccccaaatgggcttggtgatagaacctccccaatgccagtttgcccaacaacatgaacagagaaaggaggctggaaacattgaatcaggagtggaacctccagatcgcatcagacccatatactctgggaagttttttgatcggaccccttgctggccaagtgcaggaaaagttattccagttggttacagagttgcaacctgcttgactgaaaaacttcccaggctaattactccacctgaagcaaaaaagtatttcaacttcagatatccacctgctggagtagaaagagtattttacggaagagcaaatgatccccagattgcaccttatttgacacatggaattagatctaaaatttcagtactggcaaacacattgataaacccacagcctattaccacatttcaacagaaaattaaagataaaaaagaatctatatatcttagcaatcgacgagcaccattaggaaaatctcacgatcaagcaccaggattaccaaaaggcatggacacaaccaatacgacatttgggacagcagtcatcaaagaatactctgctaaagatgtggtgaatccaccaaaatcctatgaagaagtatttaaagaaggaaatgaaggacatgatttgtatgttgtttctcacaatgattattatgcaggagaggcaaagaaccgaaagtataacccatcaagtttccataggtgtagtgtgtatggagtaccaacaccacattttaatgatggacgagccatggcaaaatctctatattggctccatgaactacaaatgaaaagaggagctaagtttgtatccaaaagagcagatgatttcaaagaaaagtttcaacataaacttggaagagttttagatcccattgcagaaacaatgaatgttcccccagactgcacatttggagcttgtctccgtcctgaggaatatggagttggtgatctcatccataatagacttccggatgaatatcttcgaggcaaggatagacagcgagccctgattgcagcagttcggcatcacctgaagaaagttaattaccaaaagtttgacactttgctggcagccttcaggcactatgacaagaagggagatgggatgatagataaagacgagctgcaggaagcttgtgaccaggccaacttgagtttagatgacaagctcctggaccagctatttgactactgtgatgtggataatgatggcttcattaactatctggaattcgcaaattttcttaactggaaagacaaaatgcttcttaaagagtatgaagagagggtcattattaaaggtagaaaaccagattgtgtaaaccctactgaggctaatgttgaagaacctgaacaaactctcctcataaagccagaagatattgtcttaaaagaagcaggaagcacagaaaagactctccggacacttctgagaccaagtgataaagtttccaactactataagacaacttcttctgagatcaatgcaattgtaggagccattccttctacttgttaccccatttgtggtgttccaaccattcgatctgacattcctgctccccgaattcgtcgcatcagtgacagaactaattatggtgaagaaggtagtgcatattcactactatatcctaccatttttgcccggaaaggagtgtttgaaagagacttcttcaagaccagatcaaaagaagagattgcagagatattgtgtaacattggtgtcaaactgtctgatgaagaatttgaaaatgtatggaatcttgcatcaaaaaagcatcacagaggagaagtttgtgttgagaacatcagaaatgttctagatgagctacggcatgcagaccggatcaagtgtaaaacactcatgtgatatttttggacttcattcattcaagcaaaagaattattaactctgtgtttatctaaaatgttgaatccattctggttttagatattatgttagagttcacagtggtaagactcatatgcctgtatgtgttgctaataaattagattttggatttt

SEQ ID NO: 129187 - DNA, 2077 bp, Homo sapiens
  Payload ID: 5276
  Gene Symbol: EFHB
  Gene Name: EF-hand domain family, member B
  ENST ID: ENST00000389256
  CDS Start-End: 207-2077
gataaacagactccatcttttcctctgtgaactcggctaggtgttaagaggcaggcaggaagcaatggacagggagtccgagtgaggttgtgctctttcctgagagaggggttccgcaagggattggaggcgtctttgtagccaggtacagctttccccttagagatgagcgctcttggagaaatgagaatggggagaaatcgtccatgaacatggagattggacatccccacgaaggaaaggatgatttaggagacaagagggtcatcatgggaacaaaatttcccatggagttggggatcagagtaggattaggaaaagaagattcccgatgcggggagagccctgtggttagtaataagtgtgagggaaggatggcaccaccagaaacaaaatttccattgagcaaggggcttgaaatgggattagaaagacagaatatttctaggactgtcatgcagaggggtagtttaggagtcgacagtgtctcagcttcacagggaacaaaaccttctctgttgccaggaagaatggggttagaaaatgagagtcttcttgcaggatatacccatgaacggataatacagcctcctttgggcagggtgtgtggaagttcacaggctgcagggagcaggagagctcctttggctagtggccctgaaggggtagaggaattagtgggaaagcctgctttcgttatggaaccaagacaggaaatggaaaaagagtctacctgtgttttaatgaaacccaacacagagattaagcttcctgtggaggtggacattggactaacccaagccgaggggccagatgagactaagaatacagagccccaaatgggcttggtgatagaacctccccaatgccagtttgcccaacaacatgaacagagaaaggaggctggaaacattgaatcaggagtggaacctccagatcgcatcagacccatatactctgggaagttttttgatcggaccccttgctggccaagtgcaggaaaagttattccagttggttacagagttgcaacctgcttgactgaaaaacttcccaggctaattactccacctgaagcaaaaaagtatttcaacttcagatatccacctgctggagtagaaagagtattttacggaagagcaaatgatccccagattgcaccttatttgacacatggaattagatctaaaatttcagtactggcaaacacattgataaacccacagcctattaccacatttcaacagaaaattaaagataaaaaagaatctatatatcttagcaatcgacgagcaccattaggaaaatctcacgatcaagcaccaggattaccaaaaggcatggacacaaccaatacgacatttgggacagcagtcatcaaagaatactctgctaaagatgtggtgaatccaccaaaatcctatgaagaagtatttaaagaaggaaatgaaggacatgatttgtatgttgtttctcacaatgattattatgcaggagaggcaaagaaccgaaagtataacccatcaagtttccataggtgtagtgtgtatggagtaccaacaccacattttaatgatggacgagccatggcaaaatctctatattggctccatgaactacaaatgaaaagaggagctaagtttgtatccaaaagagcagatgatttcaaagaaaagtttcaacataaacttggaagagttttagatcccattgcagaaacaatgaatgttcccccagactgcacatttggagcttgtctccgtcctgaggaatatggagttggtgatctcatccataatagacttccggatgaatatcttcgaggcaaggatagacagcgagccctgattgcagcagttcggcatcacctgaagaaagttaattaccaaaagtttgacactttgctggcagccttcaggcactatgacaaggccagtaatgggggagagctttttggtaatgcatgggcttacagatcccagcagtttggtgtagatcaggggtcagcaaactatagcctgtgggccaaatccagcccactgtttgtttgtgtcagtaaagttttactggaacacaa

SEQ ID NO: 129188 - DNA, 782 bp, Homo sapiens
  Payload ID: 5276
  Gene Symbol: EFHB
  Gene Name: EF-hand domain family, member B
  ENST ID: ENST00000440022
  CDS Start-End: 1-782
ccagatcgcatcagacccatatactctgggaagttttttgatcggaccccttgctggccaagtctaattactccacctgaagcaaaaaagtatttcaacttcagatatccacctgctggagtagaaagagtattttacggaagagcaaatgatccccagattgcaccttatttgacacatggaattagatctaaaatttcagtactggcaaacacattgataaacccacagcctattaccacatttcaacagaaaattaaagataaaaaagaatctatatatcttagcaatcgacgagcaccattaggaaaatctcacgatcaagcaccaggattaccaaaaggcatggacacaaccaatacgacatttgggacagcagtcatcaaagaatactctgctaaagatgtggtgaatccaccaaaatcctatgaagaagtatttaaagaaggaaatgaaggacatgatttgtatgttgtttctcacaatgattattatgcaggagaggcaaagaaccgaaagtataacccatcaagtttccataggtgtagtgtgtatggagtaccaacaccacattttaatgatggacgagccatggcaaaatctctatattggctccatgaactacaaatgaaaagaggagctaagtttgtatccaaaagagcagatgatttcaaagaaaagtttcaacataaacttggaagagttttagatcccattgcagaaacaatgaatgttcccccagactgcacatttggagcttgtctccgtcctgaggaatatgg

SEQ ID NO: 129189 - DNA, 2259 bp, Homo sapiens
  Payload ID: 5277
  Gene Symbol: EFHD1
  Gene Name: EF-hand domain family, member D1
  Uniprot ID: Q9BUP0
  ENST ID: ENST00000264059
  CDS Start-End: 478-1197
cccagcctgtcccgggccgcgagcgcttccagtcgggttacttctgggggacaagaaaggcaccgtctgaacggtcgagacgctttttcccgctacggttttccccggagctgacaggggcagcaaggtcggagttgatccgagggtccctgcctggtcccggggggacggtcagcctcccgcccggagccgcggggagaggaagcaggtcggggtctccgggacgcgcagacacccagacaccggcggcctcctcccaccaggctggcagtcgctgagccctggcgcctccttaaagccgcagctccgccccgaccgccccgcccgccagtccgtcctcagaccctcccaaccgccgggtccccgccgcctcggcggagtgttgtagagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttcccggagttcagccgccgcctcatcaaggacctggagagcatgttcaaactgtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccatagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttctatctta

SEQ ID NO: 129190 - DNA, 1817 bp, Homo sapiens
  Payload ID: 5277
  Gene Symbol: EFHD1
  Gene Name: EF-hand domain family, member D1
  ENST ID: ENST00000409708
  CDS Start-End: 379-762
actctacagcgtgtatccgtggctgtaacgtgagctggtggagcagtcaaggttagacaggaaattttaattaccctggacttatctggaggcctctttcaaagggaggcaatgagggcagccacttaaaggcaggaccccaatgcaacatcttaaaatgcagccgcaaggtttttgcagcatactaaaagcttgtgttttaattccccaaagagagggtgggaagaggaacatttggctatgggaaagttgtctttttcttaagaatctgaaacggtgatgtcatggatgtcctgccagtgccagagtcccgcgttaccaagacaccagtgaaacccaaaaaggtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccatagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttc

SEQ ID NO: 129191 - DNA, 1156 bp, Homo sapiens
  Payload ID: 5277
  Gene Symbol: EFHD1
  Gene Name: EF-hand domain family, member D1
  Uniprot ID: Q9BUP0
  ENST ID: ENST00000409613
  CDS Start-End: 104-535
gctaagtgcaggcggataccccggccttggcggctgcttgcctttctccgtactgtccctgtgaaggccaagatctgtaacgctgacagtccccagacatacgatgggagagttgcagtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccatagtaacacacattagagaaaggacagaggtctgctccttcctgccacctttctcctggcccctta

SEQ ID NO: 129192 - DNA, 1538 bp, Homo sapiens
  Payload ID: 5277
  Gene Symbol: EFHD1
  Gene Name: EF-hand domain family, member D1
  ENST ID: ENST00000410095
  CDS Start-End: 104-487
aggaattacatgtttcggagactaacgagtgtcctttcatcccggtcatgcattcctttgaccctgcaggtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccatagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcc

SEQ ID NO: 129193 - DNA, 843 bp, Homo sapiens
  Payload ID: 5277
  Gene Symbol: EFHD1
  Gene Name: EF-hand domain family, member D1
  ENST ID: ENST00000442845
  CDS Start-End: 1-298
ggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttcccggagttcagccgccgcctcatcaaggacctggagagcatgttcaaactaatctgaaacggtgatgtcatggatgtcctgccagtgccagagtcccgcgttaccaagacaccagtgaaacccaaaaaggtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaaga

SEQ ID NO: 129194 - DNA, 541 bp, Homo sapiens
  Payload ID: 5277
  Gene Symbol: EFHD1
  Gene Name: EF-hand domain family, member D1
  ENST ID: ENST00000427698
  CDS Start-End: 298-541
gattacaggcgtgcaccaccatgcccagctaatttttgtatttttagtagaaacagggtttcaccatgtttgccaggctggtctacgaactcttgacctcaggtgatccgcccgcctcggcctcctgaagtgctggaattacaggcatgagccaccacgcctggctggatataccccgtttcgtttctcctttcatctgtccgcagacacccgcgttgtttccaccttttggctgttgtaaactgatttgtttttagagcaaggtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaag

SEQ ID NO: 129195 - DNA, 1490 bp, Homo sapiens
  Payload ID: 5277
  Gene Symbol: EFHD1
  Gene Name: EF-hand domain family, member D1
  ENST ID: ENST00000611312
  CDS Start-End: 1-429
atgtttcggaggtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccatagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttctatctt

SEQ ID NO: 129196 - DNA, 2419 bp, Homo sapiens
  Payload ID: 5278
  Gene Symbol: EFHD2
  Gene Name: EF-hand domain family, member D2
  Uniprot ID: Q96C19
  ENST ID: ENST00000375980
  CDS Start-End: 78-800
aggaagaggaagagcgcggccggcggcgctgcgctgagagcaggggcccggccaaggcgagtgccgcgcgggccaccatggccacggacgagctggccaccaagctgagccggcggctgcagatggagggcgagggcggcggcgagaccccggagcagcccgggctgaacggggcagcggcggcggcggcgggggcacccgacgaggcggccgaggcgctgggcagcgcggactgcgagctgagcgccaagctgctgcggcgcgcagacctcaaccagggcatcggcgagccccagtcgcccagccgccgcgtcttcaacccctacaccgagttcaaggagttctccaggaagcagatcaaggacatggagaagatgttcaagcagtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaaggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggagcaagttcaggggtcttatggaggtggcccggcccctccccgctcccttccactctgcacgaggccgccacaccggcgctggctccctgcccggcccggccctccctggcaatccctgggctctcttgcacccctaactgccccctgcctgctccggcactgccccaggcccagctcctggccctaggtccctcccagccccatgtgcctgccgcctgccctccacacatccctgtccccccaacccgggaacccctgccctcctccagcaggccgcaccgcccctggggccccctgccagccccttcccaggctgggagacggcagaagagatagaatcagggctgcccccacagagtgggacccaaggggctaattggaggcacgaggggacccctccccagggccttttcctcctctgcgtcttccatctactgaaatgggagagggggtggggagcttctgttctggtgaagggacccgggcaggcccccagcaccccatgctgacttggagaaccccagatctctggggcccagccaggcagggtgtgggggcagctgtgccaatctacctcacaggcccaccccctgccgggcatgccgtgggatcatgggcagggaaggctctgggggtcggagacaccgctgcttagcacccccagccagaacaccctgagggtctcggggctctggagagagtggggcgggaggaagaattggcaccttcctagggaaggagacgagcgcttcgccttgattctccgagaagcctccgagaagtgctttaagtgtgtttgcatgcgccaggcggtgggcagcgggggcctgtccagccctctcccgccatccttccccaagtgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaaactcgataactctttattttagtaaaatgcccaggagtcctggaagctacgcggacttgcagaggttttattttttggccttagaatctgcagaaattaggaggcaccgagcccagcgcagcagcctcggacccggattgcgtttgccttagcggatatgtttatacagatgaatataaaatgtttttttctttgggctttttgcttcttttttcccccccttctcaccttcccttctccccgaccccaccccccaaaaaagctacttcttcattccgtggtacgattattttttttaactaaaggaagataaaattctatattcttatgtg

SEQ ID NO: 129197 - DNA, 899 bp, Homo sapiens
  Payload ID: 5278
  Gene Symbol: EFHD2
  Gene Name: EF-hand domain family, member D2
  ENST ID: ENST00000445566
  CDS Start-End: 1-538
gaagatgttcaagcagtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggagttcctcctgatcttccgcaaggcggcggccggggagcttcaggaggacagcgggctgtgcgtgctggcccgcctctctgagatcgacgtctccagtgagggtgtcaagggggccaagagcttctttgaggccaagtggaactgggtgtgccgctgggctccccggacaggaagcagaggatcaggatggcagcagcttgagcgactcccttcgagcgcccttgctttgcagcagccacagaatataggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggagcaagttcaggggtcttatggaggtggcccggcccctccccgctcccttccactctgcacgaggccgccacaccggcgctggctccctgcccggcccggccctccctggcaatccctgggctctcttgcacccctaactgccccctgcctgctccggcactgccccaggcccagctcctggccctaggtccctcccagccccatgtgcctgccgcctgccctcc

SEQ ID NO: 129198 - DNA, 5438 bp, Homo sapiens
  Payload ID: 5279
  Gene Symbol: EFR3A
  Gene Name: EFR3 homolog A
  Uniprot ID: Q14156
  ENST ID: ENST00000254624
  CDS Start-End: 226-2691
gggtcgtccgtcgcgccgcccggcgaggagtgggctggcggcggtagctgtcgcccgcttggttgcgtgaccgcggggtccgcgtccgctccctccacccttcgcccttcgcccttcgcctcgttccggcctccgcggcccagcaacggccgtcatggtgccgtcggcgctccctgcgcggccccgctgagcctcggtgcggcggcgagcgcggtcgagatcgccatgcctacccgagtatgctgctgctgttccgctttgcgtcctcgctacaaacgcctggtggacaacatattccctgaagatccaaaagatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcagaataataccggatgtagctgacctaaagataaaaagagaaaaaatttgcagacaagacacaagtttcatgaaaaagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggacagtgcaattatcaatgaggataatttgccaatgttccatcgttgtggaatcatggcactggttgcagcatacctcaactttgtaagtcagatgatagctgtccctgcattttgccagcatgttagcaaggttattgaaattcgaactatggaagccccttattttctaccagagcatatcttcagagataagtgcatgcttccaaaatctttagagaagcatgaaaaagatttgtactttctgaccaacaagattgcagagtcgctaggtggaagtggatatagtgttgagagattgtcagttccgtatgtaccacaagtaacagatgaagatcgactttctagaagaaaaagcattgtggacaccgtatccattcaggtggatattttatccaacaatgttccttctgatgatgtggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcaggatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctgggactgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtatttttttaattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgtaaaaattcactgtgcaattcatatgtcagcaataaaacatagattatttgtatataagttcatttttatagctattgttacatttaattaaatttattcaatatttgcttaaattaaaaa

SEQ ID NO: 129199 - DNA, 5247 bp, Homo sapiens
  Payload ID: 5279
  Gene Symbol: EFR3A
  Gene Name: EFR3 homolog A
  Uniprot ID: Q14156
  ENST ID: ENST00000519656
  CDS Start-End: 143-2500
acagatgaggaccagtaaacacaatagaaagtttatttaatgtggagtatgctgctgctgttccgctttgcgtcctcgctacaaacgcctggtggacaacatattccctgaagatccaaaagatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcagaataataccggatgtagctgacctaaagataaaaagagaaaaaatttgcagacaagacacaagtttcatgaaaaagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggacagtgcaattatcaatgaggataatttgccaatgttccatcgttgtggaatcatggcactggttgcagcatacctcaactttgtaagtcagatgatagctgtccctgcattttgccagcatgttagcaaggttattgaaattcgaactatggaagccccttattttctaccagagcatatcttcagagataagtgcatgcttccaaaatctttagagaagcatgaaaaagatttgtactttctgaccaacaagattgcagagtcgctaggtggaagtggatatagtgttgagagattgtcagttccgtatgtaccacaagtaacagatgaagatcgactttctagaagaaaaagcattgtggacaccgtatccattcaggtggatattttatccaacaatgttccttctgatgatgtggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcaggatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctgggactgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtatttttttaattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgtaaaaattcactgtgcaattcatatgtcagcaataaaacatagattatttgtatataagttcatttttatagctattgttacatttaattaaatttattcaatatttgcttaaattaaaaa

SEQ ID NO: 129200 - DNA, 477 bp, Homo sapiens
  Payload ID: 5279
  Gene Symbol: EFR3A
  Gene Name: EFR3 homolog A
  ENST ID: ENST00000520362
  CDS Start-End: 438-477
gtttgtcctggtgagggggcacagatgaggaccagtaaacacaatagaaagtttatttaatgtggtaggtgataagtgctatgggaaaaagaaggtagagcagggtaagggtggtcagagaggcgtagatgaagaattgaagaaggtgacagagttattatagctgttagtagatacttgggcatgccccaggcagagggaacagtgagagttaagatccaaaggagggggtctagctggttagaattagcagggagaccactgtggcttgagtagagtggattgcaacaggtgggtgggggtatgccggagttgcgggcagatgacatcagaaaggaggagtatgctgctgctgttccgctttgcgtcctcgctacaaacgcctggtggacaacatattccctgaagatccaaaagatggccttgtgaaaactgatatggagaaattgacattttatgcagtatctgctccagaga

SEQ ID NO: 129201 - DNA, 780 bp, Homo sapiens
  Payload ID: 5279
  Gene Symbol: EFR3A
  Gene Name: EFR3 homolog A
  ENST ID: ENST00000522709
  CDS Start-End: 382-780
ggcgaggagtgggctggcggcggtagctgtcgcccgcttggttgcgtgaccgcggggtccgcgtccgctccctccacccttcgcccttcgcccttcgcctcgttccggcctccgcggcccagcaacggccgtcatggtgccgtcggcgctccctgcgcggccccgctgagcctcggtgcggcggcgagcgcggtcgagatcgccatgcctacccgagtatgctgctgctgttccgctttgcgtcctcgctacaaacgcctggtggacaacatattccctgaagatccaaaagtaatttgatctacatctactgatccttctctttgctgacccattctgccccccgctgacctccttaaggatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaatt

SEQ ID NO: 129202 - DNA, 1980 bp, Homo sapiens
  Payload ID: 5280
  Gene Symbol: EFR3B
  Gene Name: EFR3 homolog B
  ENST ID: ENST00000264719
  CDS Start-End: 1-1959
tttgtgaagtttgccaacatcgaggaggacaccccgtcctatcaccggagctatgacttctttgtgtcccgattcagtgaaatgtgccactcgagccatgatgacttagaaatcaagaccaaaattcgaatgtcaggcatcaaaggcctgcaaggggtggtgaggaagacggtgaatgatgaactgcaggccaatatctgggacccacagcacatggataagatcgttccatcactgcttttcaatctacagcatgtagaggaggcagagagccggtctccctcacccctccaagcacctgagaaggagaaagagagccccgcggagctggctgagaggtgtcttcgggagctgctgggccgggctgcctttggcaacatcaaaaacgccatcaagcctgttctcatccatctggataaccattctctttgggaacccaaggtgtttgccatccgttgctttaaaatcatcatgtactcaattcagccgcagcactcacacctggtcatccagcagctcctgggccacctggacgccaacagccgcagcgctgcgacggtgcgcgcgggcatcgtggaagtcttgtcggaagccgcggtcatcgctgccaccggctctgtggggcccacagtactggagatgttcaacacgctgctgaggcagctgcggctcagcatcgactacgcgctgaccgggagctacgacggggcggtcagcctcggcaccaagatcatcaaggagcacgaggagcgcatgttccaggaggccgtcatcaagaccgtgggctcctttgccagcacgctgcccacctaccagcgctccgaggtgatcctcttcatcatgagcaaggtcccgcggccatccctgcaccaggcggtggacacaggcaggacgggggagaataggaaccgtctgacccagattatgctgctaaaatccctcctgcaggtatccacaggtttccagtgcaacaacatgatgtcagccctgcctagcaacttcctggaccgccttctctccaccgccctcatggaggatgcagaaattcgactctttgttctagagattctcatcagtttcattgatcgtcatggcaaccgccacaagttctctaccatcagtaccctcagtgacatctctgtcctgaagctgaaagtggacaagtgctctcgacaggacaccgtcttcatgaagaagcactcccagcagctctacagacacatctacctgagctgcaaggaggaaacaaacgtgcagaaacactacgaggcgctctatggcttgctggccctcatcagcatcgagctggctaacgaggaggtggtggtggacctcatccgtctggtgctggctgttcaggtgatagagaccaggaagaaagaggctccatacatgctccccgaggatgtgtttgtggagaggcccaggctgtctcagaatcttgatggggtggtcattgagctcctcttccgccagagcaagatcagtgaagtcctgggaggcagtggctacaactcggaccggctctgcctgccctacattcctcagctgacagatgaggatcgtttatccaagaggaggagcattggagagaccatctccctgcaggtggaggtagaatcgaggaacagtccggagaaggaggagcgagtgcctgccgaggagatcacctatgagacactgaagaaagccattgtggacagcgtagcagtggaggagcaggagcgtgagcggcggcggcaggtggtggagaagttccagaaggcacccttcgaggagattgctgcacactgcggggcccgggcatcgctgctccagagcaaactcaatcagatctttgaaatcaccatccggcccccaccaagcccatcaggaaccatcactgcagcctacggtcagccgcagaaccactccatccccgtctatgaaatgaagtttcccgatctgtgtgtatactgaattccaagagcctgagctcct

SEQ ID NO: 129203 - DNA, 7434 bp, Homo sapiens
  Payload ID: 5280
  Gene Symbol: EFR3B
  Gene Name: EFR3 homolog B
  Uniprot ID: Q9Y2G0
  ENST ID: ENST00000403714
  CDS Start-End: 184-2637
gctggcggcgcccggctccgtcctgcccgcggccggcccccgcgtctgctccctccccgcccgggcccctgtcggccgccgccagtccccgccccgactgtgaatgaaaggcgggcgccgccgagggctggctgggaacgccgcagcgacgccggcctctcgagaggcgcgcgccccgccgagatgtacggtgtgtgtggctgctgtggtgccctacgccccaggtacaaaaggctggttgacaacatcttccctgaggatcccgaggatggtctggtgaagaccaacatggagaagctgaccttctatgccctctcagctccagaaaaacttgatcgtattggcgcctacctctctgagaggctcatccgtgacgtgggtcgccatcgatatgggtacgtgtgcattgctatggaggctttggaccagctgctcatggcctgccactgccagagcatcaacctcttcgtggagagcttcctcaagatggtggccaagctgctggagtcagagaaacccaacctgcagatcctcggcaccaactcgtttgtgaagtttgccaacatcgaggaggacaccccgtcctatcaccggagctatgacttctttgtgtcccgattcagtgaaatgtgccactcgagccatgatgacttagaaatcaagaccaaaattcgaatgtcaggcatcaaaggcctgcaaggggtggtgaggaagacggtgaatgatgaactgcaggccaatatctgggacccacagcacatggataagatcgttccatcactgcttttcaatctacagcatgtagaggaggcagagagccggtctccctcacccctccaagcacctgagaaggagaaagagagccccgcggagctggctgagaggtgtcttcgggagctgctgggccgggctgcctttggcaacatcaaaaacgccatcaagcctgttctcatccatctggataaccattctctttgggaacccaaggtgtttgccatccgttgctttaaaatcatcatgtactcaattcagccgcagcactcacacctggtcatccagcagctcctgggccacctggacgccaacagccgcagcgctgcgacggtgcgcgcgggcatcgtggaagtcttgtcggaagccgcggtcatcgctgccaccggctctgtggggcccacagtactggagatgttcaacacgctgctgaggcagctgcggctcagcatcgactacgcgctgaccgggagctacgacggggcggtcagcctcggcaccaagatcatcaaggagcacgaggagcgcatgttccaggaggccgtcatcaagaccgtgggctcctttgccagcacgctgcccacctaccagcgctccgaggtgatcctcttcatcatgagcaaggtcccgcggccatccctgcaccaggcggtggacacaggcaggacgggggagaataggaaccgtctgacccagattatgctgctaaaatccctcctgcaggtatccacaggtttccagtgcaacaacatgatgtcagccctgcctagcaacttcctggaccgccttctctccaccgccctcatggaggatgcagaaattcgactctttgttctagagattctcatcagtttcattgatcgtcatggcaaccgccacaagttctctaccatcagtaccctcagtgacatctctgtcctgaagctgaaagtggacaagtgctctcgacaggacaccgtcttcatgaagaagcactcccagcagctctacagacacatctacctgagctgcaaggaggaaacaaacgtgcagaaacactacgaggcgctctatggcttgctggccctcatcagcatcgagctggctaacgaggaggtggtggtggacctcatccgtctggtgctggctgttcaggacgtggcccaagtcaatgaggagaacttgcctgtctacaaccgctgtgccctctatgctctgggcgcagcctacctgaacctcatcagtcagctcacaacagtgcctgccttctgccagcacatccatgaggtgatagagaccaggaagaaagaggctccatacatgctccccgaggatgtgtttgtggagaggcccaggctgtctcagaatcttgatggggtggtcattgagctcctcttccgccagagcaagatcagtgaagtcctgggaggcagtggctacaactcggaccggctctgcctgccctacattcctcagctgacagatgaggatcgtttatccaagaggaggagcattggagagaccatctccctgcaggtggaggtagaatcgaggaacagtccggagaaggaggagcgagtgcctgccgaggagatcacctatgagacactgaagaaagccattgtggacagcgtagcagtggaggagcaggagcgtgagcggcggcggcaggtggtggagaagttccagaaggcacccttcgaggagattgctgcacactgcggggcccgggcatcgctgctccagagcaaactcaatcagatctttgaaatcaccatccggcccccaccaagcccatcaggaaccatcactgcagcctacggtcagccgcagaaccactccatccccgtctatgaaatgaagtttcccgatctgtgtgtatactgaattccaagagcctgagctcctcaaggagatggggtctgaggaggggctcacctcacgcccaccccgaccacatggagatctggctgtgatctctgagaaaacatcaccttagatggcagcgcctcccaggctaagccaaggtggagactctctggtccttcttggccctcctacctcctcctcgtcttccctgagggaggtctcaccaatcagcatctcacctgtgccctctttgtcttctcttgtgtcagccaggggcagagaatcatggggtgtctctcaggagaagccggggggagggggctgagaagctcctacttggtgttttgagtgaagggcatgtcctccccagaggacggagctggatggagacttggttggtgagaggaagctaaggactctactcccctggggaaggaagctgagatggggatggctctctcctccccagcactccccctgctccccgcccatgtccctgctgtgtctctcactctcttgctcatctcccagttgtctgttcatgtttctttctactattaatgaatgctgagcccttataacaggagctggggtggagacatcacgaggggtcgggggacagcaaagggcaggaagcaggatgcagggctggcaggaggtgggcctgtggcatcagcaggcccagcgggcgagtgtggtccctgcagcagcttcccacctcctttgttcataaggagcttgtgttggcctcccacagtcctgtctgctggacgtttttcagagttgggttctctctctttgatgtctttcttctgagggtcccaaggtgttcctggagcttctgggttgaggaaaggcagagcaagataatcttggaggggaactacagggtccccaagatttgcccacatcacctcctatggaaaaggctcccagcctgacctgggttgtaggagagtggggagggtgggatgagtggtgttttggggctcaaggatatcagaagccaactttttggatgttccgtttgaagaaagaaggatctaacacctaatattggaatgatttcttcactctctggacaaagtctgggacatcagcaccacctggcaacgcttgtggcttgggaggagccatggagacccctttgggttctgggttcctgttttcctggtgtgccgtctgtgtctctgtgtaatgaggatgtgcagagaggagctaacgcggagccgggcagagccacccaggaggcagtttgttgccttctttgccaattccccttcccggcccctcctccaggtgcctttgtgtctcccggggtgccactgacagaacctcacctggggctcctcccatggcagtgccatgtggtccaaaattgccctttccttctccgttagtcacatttcccataactcctccgagccaacataacctacagtaagatgtgagtgtcagacgttctctccctggagtctgctttccaaaggaggcagggtgagtagatttcttgatccaaaggaatccgtttttaatttttttttttttctagagatgggggtctcactatgttgcccaggctggcctcgaactcctgagtttaagtgattctcccacctcagcctcctgagtagctgagaatccctttttagggtacaatttcaggcagtgtggcatggagtcagaagcaggctgtttctcctcaggggagggcaggcttctcaggacggcctcagctcatagccccacgtgtggtgtgcacggatgtgcagggagagcctgattgttaggtggatgtattttccagaatcggggagggactgaacacgagcatttcccattaatatgtgcaataaatgtcttggggaaggggctatttgaccctcattcccatagttttggcacttcaaatgaagctcttccttgtggtcaccatctctgctgtgggcacacagcttctttttcttgtttttttttttttttttttttttttgagacaccgtctcgctctgtcacccaggctggagtacaatggtgtgacctcaactcactgtgacttccgcctcctgggttcaagtgattctcctgcctcagcctcctgagtagctgggattacaggcgtgcaccaccacgcctggcgaattttgtgtttttagtagacatgaggtttcaccgtgttggccaggctggtctggaactcctgatctcaagtgatccgcccgcctcagcctctcaaagtgctgggattacaggcgtgagccactgcgcctgcttggcacgtggcttctgaatggcctgagtgagggcagggcccaggcatggaggctcctgcacccccaaggctttttggctgtgctttatggcctctggcttatactcaacccaattttacaagcatgaacttagacttctctttagtatttatatatttaaaaaccaagtttaaattaactcaaacttgacagcaactaacctctgaaagaaactttaaagaaaattgaaatcttgagccacaaacatgttctttcctcactagctcctcccaggttttatcctgcacccagcttggatgagagacccactgtttcttgtgcctacttaacattagggttccccgtggcagcttcatcctgagcactgcctgtgagccctggttctgggacttggcagtcgcctccctggagcatctttccagagccagcattagaacctgagatccccagatgtttctgcccctcatccccatcctgtgaatagagagacagaaaaggtgcaggttcccattctgcatagattctgctgtttcctctccaccggtcccaggcagcttttcctttccatcactgccgcttagcaaaaatgtgcttcttttgaagaactggtcattttttttgagtgccctcttctcagttttgtttaaacttacactcagtagagtgttgggttgtctgctgacatggagtagaacctggattctggccaaataggccagaatcggaaaggtgaaggtgagtgtgatagtaggtaatctcctcaccccagcacaggccctgggagagaggcaaagcagtttgatgggatctggaggggagggaggtaccctggcccttggtctagcatcagtgagtcctgcccttccaagcccctggaggctagtggcattgcattgtgcccctttttgccacccttctctgatgtgattttgagcgaagaggagtcagtaagcccattgagaccggctgctcccaaagcccgaggactctagctgtgtggggaagggctagcattggtcaggactctgctgacagcactgagtaggcaggaatgtatttgagatttggaagtactgttaatttggtggagtcaggtgaatggataagaggcagatcggcagaaagcatcagtgtggtcccgaggctccctctgttttccttgccatggagtccccagcgccttgtgcctgtttccatttccctctctctttgaaaagtagaaatcagtggtttcttgactcctaaacagcctcctcactatagaaggagcctgagcaggtcagaagaactagaaaagtcctcagatacccccctctgtccagccccctttcccatacacagatatcaatggatgagcaggaaaagaggaggcctggactcactgaagtacttgaagaagcacaagtgtcatagatgtgccgccctttgccctgggtgttctagatcacacagaacacgtttcagctggactaagaatcagactagccaggggttcttctgaacagctcaggccagacctctgggctcctctgggggccctgggacatgatgccttgcagtttccattccattgtccccaggcctcctgacctggtgacagagagtgccctgcagaagtgagtctatttttcccaattcctcttcatgaccagaaaatggcagctggccggttggggtcctgtgggaaagggctaacctgggctgttaggtagacactaggtttaaaggtagacagggagatggcatcatcagggcaggccaggcccacttcctgtgaccccagaccttggcaggcgggtcgtgctgaaaccaggcatctccctcacacctggggaaaggtttagggcaacatgttgcctcttcatcccattaaccctagaaatcttctggttagagtggccccttaccccaaatctggcctaggtctgaagactgcaggatagtcatgatgggcccatcctagagcctggctagctggaagacgcggtatggcagggacaggagggcggcaggaagggctttgtggccctgctggggccaaaggcagttttctgtgctccctttagccccagcctggctggccaggtctcctgtacttcaggggaccatggggccgcccaagccagtcaccttccccttccaagctctccccccatgactgttgatttctggcgcgtggaggcagagttgtgaatccacaaatgctgtagcccatatctcgtaatgtgtctgtgtccacttagagcctcacgacctggctgtgtgtgtgcatgtgtgtgtagtatagtttgtagttgacaatatgtgtatataatagctggtgtatttatatgtgagtgcagaattagtgcccgtggcggttttctgtattttaaacccattgaattggttagttttattttagggaagtgggaaaggcggagtggggggaagtataggaagaaggattcttagcaaaatcattctctaggactattagtcgcgatctcccagtgagccatcacgatgcccttttcaaataaatgttaatgttgtcaccaca

SEQ ID NO: 129204 - DNA, 2432 bp, Homo sapiens
  Payload ID: 5280
  Gene Symbol: EFR3B
  Gene Name: EFR3 homolog B
  Uniprot ID: Q9Y2G0
  ENST ID: ENST00000405108
  CDS Start-End: 198-2207
gcaaataagctttactacaaccatatctgaaatgtgttttcctgatcaagtgggatgggaaagaacagtgagtggagtcccaggcatgttaagaatggcgtgctgttttttaagtgtttgtgaagtttgccaacatcgaggaggacaccccgtcctatcaccggagctatgacttctttgtgtcccgattcagtgaaatgtgccactcgagccatgatgacttagaaatcaagaccaaaattcgaatgtcaggcatcaaaggcctgcaaggggtggtgaggaagacggtgaatgatgaactgcaggccaatatctgggacccacagcacatggataagatcgttccatcactgcttttcaatctacagcatgtagaggaggcagagagccggtctccctcacccctccaagcacctgagaaggagaaagagagccccgcggagctggctgagaggtgtcttcgggagctgctgggccgggctgcctttggcaacatcaaaaacgccatcaagcctgttctcatccatctggataaccattctctttgggaacccaaggtgtttgccatccgttgctttaaaatcatcatgtactcaattcagccgcagcactcacacctggtcatccagcagctcctgggccacctggacgccaacagccgcagcgctgcgacggtgcgcgcgggcatcgtggaagtcttgtcggaagccgcggtcatcgctgccaccggctctgtggggcccacagtactggagatgttcaacacgctgctgaggcagctgcggctcagcatcgactacgcgctgaccgggagctacgacggggcggtcagcctcggcaccaagatcatcaaggagcacgaggagcgcatgttccaggaggccgtcatcaagaccgtgggctcctttgccagcacgctgcccacctaccagcgctccgaggtgatcctcttcatcatgagcaaggtcccgcggccatccctgcaccaggcggtggacacaggcaggacgggggagaataggaaccgtctgacccagattatgctgctaaaatccctcctgcaggtatccacaggtttccagtgcaacaacatgatgtcagccctgcctagcaacttcctggaccgccttctctccaccgccctcatggaggatgcagaaattcgactctttgttctagagattctcatcagtttcattgatcgtcatggcaaccgccacaagttctctaccatcagtaccctcagtgacatctctgtcctgaagctgaaagtggacaagtgctctcgacaggacaccgtcttcatgaagaagcactcccagcagctctacagacacatctacctgagctgcaaggaggaaacaaacgtgcagaaacactacgaggcgctctatggcttgctggccctcatcagcatcgagctggctaacgaggaggtggtggtggacctcatccgtctggtgctggctgttcaggacgtggcccaagtcaatgaggagaacttgcctgtctacaaccgctgtgccctctatgctctgggcgcagcctacctgaacctcatcagtcagctcacaacagtgcctgccttctgccagcacatccatgaggtgatagagaccaggaagaaagaggctccatacatgctccccgaggatgtgtttgtggagaggcccaggctgtctcagaatcttgatggggtggtcattgagctcctcttccgccagagcaagatcagtgaagtcctgggaggcagtggctacaactcggaccggctctgcctgccctacattcctcagctgacagatgaggatcgtttatccaagaggaggagcattggagagaccatctccctgcaggtggaggtagaatcgaggaacagtccggagaaggaggagcgagtgcctgccgaggagatcacctatgagacactgaagaaagccattgtggacagcgtagcagtggaggagcaggagcgtgagcggcggcggcaggtggtggagaagttccagaaggcacccttcgaggagattgctgcacactgcggggcccgggcatcgctgctccagagcaaactcaatcagatctttgaaatcaccatccggcccccaccaagcccatcaggaaccatcactgcagcctacggtcagccgcagaaccactccatccccgtctatgaaatgaagtttcccgatctgtgtgtatactgaattccaagagcctgagctcctcaaggagatggggtctgaggaggggctcacctcacgcccaccccgaccacatggagatctggctgtgatctctgagaaaacatcaccttagatggcagcgcctcccaggctaagccaaggtggagactctctggtccttcttggccctcctacctcctcctcgtcttccctgagggaggtctcaccaatcagcatctcacctgt

SEQ ID NO: 129205 - DNA, 3685 bp, Homo sapiens
  Payload ID: 5280
  Gene Symbol: EFR3B
  Gene Name: EFR3 homolog B
  ENST ID: ENST00000402191
  CDS Start-End: 303-2651
gtgcgcgcgcgtctgcgctgcgaggacaaagatgcctcgggccggggaccctggggtcctctccaggcccggcgcgtgccggtgctgggcggtggtccttcggggggcggaggctcaggggaaagcgggtctcccggagccgagcagaccgggagtgctggaggaggtggtcgtgtggcagcatttgcggaattaacaaaagcggtgtgtgtggctgctgtggtgccctacgccccaggtacaaaaggctggttgacaacatcttccctgaggatcccgaggatggtctggtgaagaccaacatggagaagctgaccttctatgccctctcagctccagaaaaacttgatcgtattggcgcctacctctctgagaggctcatccgtgacgtgggtcgccatcgatatgggtacgtgtgcattgctatggaggctttggaccagctgctcatggcctgccactgccagagcatcaacctcttcgtggagagcttcctcaagatggtggccaagctgctggagtcagagaaacccaacctgcagatcctcggcaccaactcgtttgtgaagtttgccaacatcgaggaggacaccccgtcctatcaccggagctatgacttctttgtgtcccgattcagtgaaatgtgccactcgagccatgatgacttagaaatcaagaccaaaattcgaatgtcaggcatcaaaggcctgcaaggggtggtgaggaagacggtgaatgatgaactgcaggccaatatctgggacccacagcacatggataagatcgttccatcactgcttttcaatctacagcatgtagaggaggcagagagccggtctccctcacccctccaagcacctgagaaggagaaagagagccccgcggagctggctgagaggtgtcttcgggagctgctgggccgggctgcctttggcaacatcaaaaacgccatcaagcctgttctcatccatctggataaccattctctttgggaacccaaggtgtttgccatccgttgctttaaaatcatcatgtactcaattcagccgcagcactcacacctggtcatccagcagctcctgggccacctggacgccaacagccgcagcgctgcgacggtgcgcgcgggcatcgtggaagtcttgtcggaagccgcggtcatcgctgccaccggctctgtggggcccacagtactggagatgttcaacacgctgctgaggcagctgcggctcagcatcgactacgcgctgaccgggagctacgacggggcggtcagcctcggcaccaagatcatcaaggagcacgaggagcgcatgttccaggaggccgtcatcaagaccgtgggctcctttgccagcacgctgcccacctaccagcgctccgaggtgatcctcttcatcatgagcaaggtcccgcggccatccctgcaccaggcggtggacacaggcaggacgggggagaataggaaccgtctgacccagattatgctgctaaaatccctcctgcaggtatccacaggtttccagtgcaacaacatgatgtcagccctgcctagcaacttcctggaccgccttctctccaccgccctcatggaggatgcagaaattcgactctttgttctagagattctcatcagtttcattgatcgtcatggcaaccgccacaagttctctaccatcagtaccctcagtgacatctctgtcctgaagctgaaagtggacaagtgctctcgacaggacaccgtcttcatgaagaagcactcccagcagctctacagacacatctacctgagctgcaaggaggaaacaaacgtgcagaaacactacgaggcgctctatggcttgctggccctcatcagcatcgagctggctaacgaggaggtggtggtggacctcatccgtctggtgctggctgttcaggacgtggcccaagtcaatgaggagaacttgcctgtctacaaccgctgtgccctctatgctctgggcgcagcctacctgaacctcatcagtcagctcacaacagtgcctgccttctgccagcacatccatgaggtgatagagaccaggaagaaagaggctccatacatgctccccgaggatgtgtttgtggagaggcccaggctgtctcagaatcttgatggggtggtcattgagctcctcttccgccagagcaagatcagtgaagtcctgggaggcagtggctacaactcggaccggctctgcctgccctacattcctcagctgacagatgaggatcgtttatccaagaggaggagcattggagagaccatctccctgcaggtggaggtagaatcgaggaacagtccggagaaggaggagcgagtgcctgccgaggagatcacctatgagacactgaagaaagccattgtggacagcgtagcagtggaggagcaggagcgtgagcggcggcggcaggtggtggagaagttccagaaggcacccttcgaggagattgctgcacactgcggggcccgggcatcgctgctccagagcaaactcaatcagatctttgaaatcaccatccggcccccaccaagcccatcaggaaccatcactgcagcctacggtcagccgcagaaccactccatccccgtctatgaaatgaagtttcccgatctgtgtgtatactgaattccaagagcctgagctcctcaaggagatggggtctgaggaggggctcacctcacgcccaccccgaccacatggagatctggctgtgatctctgagaaaacatcaccttagatggcagcgcctcccaggctaagccaaggtggagactctctggtccttcttggccctcctacctcctcctcgtcttccctgagggaggtctcaccaatcagcatctcacctgtgccctctttgtcttctcttgtgtcagccaggggcagagaatcatggggtgtctctcaggagaagccggggggagggggctgagaagctcctacttggtgttttgagtgaagggcatgtcctccccagaggacggagctggatggagacttggttggtgagaggaagctaaggactctactcccctggggaaggaagctgagatggggatggctctctcctccccagcactccccctgctccccgcccatgtccctgctgtgtctctcactctcttgctcatctcccagttgtctgttcatgtttctttctactattaatgaatgctgagcccttataacaggagctggggtggagacatcacgaggggtcgggggacagcaaagggcaggaagcaggatgcagggctggcaggaggtgggcctgtggcatcagcaggcccagcgggcgagtgtggtccctgcagcagcttcccacctcctttgttcataaggagcttgtgttggcctcccacagtcctgtctgctggacgtttttcagagttgggttctctctctttgatgtctttcttctgagggtcccaaggtgttcctggagcttctgggttgaggaaaggcagagcaagataatcttggaggggaactacagggtccccaagatttgcccacatcacctcctatggaaaaggctcccagcctgacctgggttgtaggagagtggggagggtgggatgagtggtgttttggggctcaaggatatcagaagccaactttttggatgttccgtttgaagaaagaaggatctaacacct

SEQ ID NO: 129206 - DNA, 5162 bp, Homo sapiens
  Payload ID: 5280
  Gene Symbol: EFR3B
  Gene Name: EFR3 homolog B
  Uniprot ID: Q9Y2G0
  ENST ID: ENST00000401432
  CDS Start-End: 184-2370
gctggcggcgcccggctccgtcctgcccgcggccggcccccgcgtctgctccctccccgcccgggcccctgtcggccgccgccagtccccgccccgactgtgaatgaaaggcgggcgccgccgagggctggctgggaacgccgcagcgacgccggcctctcgagaggcgcgcgccccgccgagatgtacggtgtgtgtggctgctgtggtgccctacgccccaggtacaaaaggctggttgacaacatcttccctgaggatcccgaggatggtctggtgaagaccaacatggagaagctgaccttctatgccctctcagctccagaaaaacttgatcgtattggcgcctacctctctgagaggctcatccgtgacgtgggtcgccatcgatatgggtacgtgtgcattgctatggaggctttggaccagctgctcatggcctgccactgccagagcatcaacctcttcgtggagagcttcctcaagatggtggccaagctgctggagtcagagaaacccaacctgcagatcctcggcaccaactcgtttgtgaagtttgccaacatcgaggaggacaccccgtcctatcaccggagctatgacttctttgtgtcccgattcagtgaaatgtgccactcgagccatgatgacttagaaatcaagaccaaaattcgaatgtcaggcatcaaaggcctgcaaggggtggtgaggaagacggtgaatgatgaactgcaggccaatatctgggacccacagcacatggataagatcgttccatcactgcttttcaatctacagcatgtagaggaggcagagagccggtctccctcacccctccaagcacctgagaaggagaaagagagccccgcggagctggctgagaggtgtcttcgggagctgctgggccgggctgcctttggcaacatcaaaaacgccatcaagcctgttctcatccatctggataaccattctctttgggaacccaaggtgtttgccatccgttgctttaaaatcatcatgtactcaattcagccgcagcactcacacctggtcatccagcagctcctgggccacctggacgccaacagccgcagcgctgcgacggtgcgcgcgggcatcgtggaagtcttgtcggaagccgcggtcatcgctgccaccggctctgtggggcccacagtactggagatgttcaacacgctgctgaggcagctgcggctcagcatcgactacgcgctgaccgggagctacgacggggcggtcagcctcggcaccaagatcatcaaggagcacgaggagcgcatgttccaggaggccgtcatcaagaccgtgggctcctttgccagcacgctgcccacctaccagcgctccgaggtgatcctcttcatcatgagcaaggtcccgcggccatccctgcaccaggcggtggacacaggcaggacgggggagaataggaaccgtctgacccagattatgctgctaaaatccctcctgcaggtatccacaggtttccagtgcaacaacatgatgtcagccctgcctagcaacttcctggaccgccttctctccaccgccctcatggaggatgcagaaattcgactctttgttctagagattctcatcagtttcattgatcgtcatggcaaccgccacaagttctctaccatcagtaccctcagtgacatctctgtcctgaagctgaaagtggacaagtgctctcgacaggacaccgtcttcatgaagaagcactcccagcagctctacagacacatctacctgagctgcaaggaggaaacaaacgtgcagaaacactacgaggcgctctatggcttgctggccctcatcagcatcgagctggctaacgaggaggtggtggtggacctcatccgtctggtgctggctgttcaggacgtggcccaagtcaatgaggagaacttgcctgtctacaaccgctgtgccctctatgctctgggcgcagcctacctgaacctcatcagtcagctcacaacagtgcctgccttctgccagcacatccatgaggtgatagagaccaggaagaaagaggctccatacatgctccccgaggatgtgtttgtggagaggcccaggctgtctcagaatcttgatggggtggtcattgagctcctcttccgccagagcaagatcagtgaagtcctgggaggcagtggctacaactcggaccggctctgcctgccctacattcctcagctgacagatgaggatcgtttatccaagaggaggagcattggagagaccatctccctgcaggtggaggtagaatcgaggaacagtccggagaaggaggaggtgagtgtccgtgccaccgtcctggggcagccccacctcctgtagattggacgctggactccaggctcccctgcctgcatagtgggcttaaggctgcatggaaagcaagtttctcgagtaattccacacttgtactgactctccccacgtatgcgtcatagatacttcccttcggaaaaattgttagggtcctccctgctcccatgaggatatcataaaactcactcttgaaaggcctggctggggatggtggctcacacctgtgatcccaacattttggaggctgaggcaggaggactgcttgagcccaggagtttgagatgatctggggcaatataaggagaccccatctctacaaaaaataattgaaaaatcagccaggcatggtgacgtgcacctgtggtcccaggtactcaggatgctgaggtgggagaatcacctgagcctgggaggtcaaggctgctgtaagccatgatggcagcacggcacttcagcctaggtgacagagtgagacctcgtctcaaaaaattaaaaagaaaggcatgctggtcatcattccccactcacagggggaccgatatgctctgggttggaaactagaagacttaactggagagataagggtgagaacagctttcatagtgttgcttccgtatgtatcaataaagaatctttttttaaatttacactatttttaaagcaattttagttacagcaaaattgagaggaaggtacagagatcgccctttgccccctcccctcccctgacacatgcacagcctcccctcctatccatatcccccagcagagtggtgcatttcttacagttcaacctgccttaacacaacagtatcatctgaagtctgtcgtttacactggggttcgccctcagcgttgtacattctgtgggtttggacaaatgcgtaatgacatgcatcccccaccagagtaccatacagagtcatttcctgccctaaaaccccctgtgctccacctcttcatctctcccctaaccactgacagccaagatgttttttttttttttttttttaatgctgactgttacagttcacaagaagtacggaggacacacatctgggtgggaccgggacagaaagacttacatggtcctcaggcatggacaggctggcattccccagcctctctgcccattagggctgatatagacatggaggacagctttgacatcaagcctttccccagatgcaatcagaggtaggagaagtctctaggggtcaggatcaagcctccccctaactgtgccctcgaccacttcatttattggggcagatctctaccccagggccctcaaagcttatccagaaccttcccacggaaggaagctctgacttgggctaattggacaagtaaaatgaggttgaacgaggcatcctccatggcccttccagctccaaggactgggaacctccaatgcgttaggcatcggggtgagttggctgctctctccccatagtggcgattctcccttcccaagaggtaagagaccctcgggaattgaggagtgaagtgactcagaagcgcaaggcgaaatgcttacacagctacagagccacctcctcactagtggcctcctgggccaccagtatcagttccttcctcccttcaagagtcagcttagcccagaggtagcttggtggcaaagcaggggtgcaggggccttcatcctgtgcccttctgccatgccacaactctctccactctcagccatcagtgccagtccagagtcccacggtggttcctagggccgtactgcccagccttgccgcaggggtgaataaatgcttgtttggtcaaatctgaatcctggtgcctggcattcccagccatgcatagtctgggctctgccatttcatttttccccacctgctctggcccgtatccactgtcccactctggtggggctgctctcgatctctcccacgctgcgctccgccatctccaggcctttgctagtgcagaatgccacatctgaaccacccttccctccacactggtgcagctgagcgcctgtgaactgtctgttctccagcgcccggcccctgttcagtttcctcataaacttctctctccctgctcttgcccagggagcatcccttctctcttgcccagagagcggcattttctttgactgttgccaccacacagttccctagcaccctgcaggtgaatatccaatgttgctcggtgctgacagtggatgaatggatggacgtacagaggataagtcctcagagcgagttaaagccgagcatagctctctcttgcatgtaattcctatgctagcaaattgtgcagtttctatagactcacctacagtcctgcatgtagttggtgctcacttaatgtttgttaaatgactttatctcatacatatacttctgtcctctcctactcaaacaaaaatgccaaacaaatcaaaaaatgcacgactcagtgaattttcataaagtgtgtatgcccacgcaaccacgcctggatgagagagtggaacactgtcatcatccaggggccctgcctctgtgccccctcccctaagggagctcccagcctgagttgcgttacttctggaactttatatcaatgaaatcattctgttctgtgtctgctgcttttgcttaagattatgtttaaatgatagagcatgaggctgggcgtggtggctcatgcctgtaatctcagcactttgggaggccaaggcaggtggatcacctgaggttaggagttcaagaccagcctgatcaacatggtgaaaccccgtctttactaaaactacaaaaaattagccgggcatggtg

SEQ ID NO: 129207 - DNA, 1820 bp, Homo sapiens
  Payload ID: 5281
  Gene Symbol: EFEMP1
  Gene Name: EGF containing fibulin-like extracellular matrix protein 1
  Uniprot ID: Q12805
  ENST ID: ENST00000355426
  CDS Start-End: 126-1607
agatcagacccacggggctgccctcccctgcgcactcccctcgctgcccgggcccggagcgcagcgcggccgcacaggtatttttgctgtgctgtgcaaggaactctgctagctcaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaa

SEQ ID NO: 129208 - DNA, 3024 bp, Homo sapiens
  Payload ID: 5281
  Gene Symbol: EFEMP1
  Gene Name: EGF containing fibulin-like extracellular matrix protein 1
  Uniprot ID: Q12805
  ENST ID: ENST00000394555
  CDS Start-End: 437-1918
agatgctgtgttcccctcctcagagaagaagaaaacgcactagagagtgggagcatccccaaggctgaagcgcatccaggacatcacatgtcaacgtgtcctctctggcgtggggtccccgcgagtctgggaaacgaggagctggcaagggagggcaagcgggggcggcaaagagggcccctggagcagggggcgcggacctcgctgcgctgcgcgctctaccgccgggctcgcaacgctgggctcagcgctcgcgcctccctcagctctctcctccgccccccttcgccctccccctttccctccctttctcctcctcctcctgccgccgcggccgctgccggacttcgccagatcagacccacggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggggatctgccatatttgtgttggtttttattttcatatccagcctaaaggtggttgtttattatatagtaataaatcattgctgtacaatatgctggtttctgtagggtatttttaattttgtcagaaattttagattgtgaatattttgtaaaaaacagtaagcaaaattttccagaattcccaaaatgaaccagatatcccctagaaaattatactattgagaaatctatggggaggatatgagaaaataaattccttctaaaccacattggaactgacctgaagaagcaaactcggaaaatataataacatccctgaattcaggacttccacaagatgcagaacaaaatggataaaaggtatttcactggagaagttttaatttctaagtaaaatttaaatcctaacacttcactaatttataactaaaatttctcatcttcgtacttgatgctcacagaggaagaaaatgatgatggtttttattcctggcatccagagtgacagtgaacttaagcaaattaccctcctacccaattctatggaatattttatacgtctccttgtttaaaatgtcactgctttactttgatgtatcatatttttaaataaaaataaatattcctttagaagatca

SEQ ID NO: 129209 - DNA, 558 bp, Homo sapiens
  Payload ID: 5281
  Gene Symbol: EFEMP1
  Gene Name: EGF containing fibulin-like extracellular matrix protein 1
  ENST ID: ENST00000429909
  CDS Start-End: 298-558
agacccacggggctgccctcccctgcgcactcccctcgctgcccgggcccggagcgcagcgcggccgcacaggtatttttgctgtgctgtgcaaggaactctgctagctcaagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaaggttcaggagggggaggggagatgagaaagcagattggaaattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaa

SEQ ID NO: 129210 - DNA, 733 bp, Homo sapiens
  Payload ID: 5281
  Gene Symbol: EFEMP1
  Gene Name: EGF containing fibulin-like extracellular matrix protein 1
  ENST ID: ENST00000438672
  CDS Start-End: 217-733
gacccacggggctgccctcccctgcgcactcccctcgctgcccgggcccggagcgcagcgcggccgcacagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaag

SEQ ID NO: 129211 - DNA, 559 bp, Homo sapiens
  Payload ID: 5281
  Gene Symbol: EFEMP1
  Gene Name: EGF containing fibulin-like extracellular matrix protein 1
  ENST ID: ENST00000440439
  CDS Start-End: 242-559
agacccacggggctgccctcccctgcgcactcccctcgctgcccgggcccggagcgcagcgcggccgcacaggtatttttgctgtgctgtgcaaggaactctgctagctcaagcgtagcaggatggagtaacgtgaaatgcaattctacagcagtttttacgtctttgctgcctcgttcgttggctaccgagaaggttcaggagggggaggggagatgagaaagcagattggaaattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagc

SEQ ID NO: 129212 - DNA, 339 bp, Homo sapiens
  Payload ID: 5281
  Gene Symbol: EFEMP1
  Gene Name: EGF containing fibulin-like extracellular matrix protein 1
  ENST ID: ENST00000424207
  CDS Start-End: 259-339
agacccacggggctgccctcccctgcgcactcccctcgctgcccgggcccggagcgcagcgcggccgcacaggtatttttgctgtgctgtgcaaggaactctgctagctcaagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaagattcacaatgttgaaagcccttttcctaactatgctgactctggcgctggtcaagtcacaggacaccgaagaaaccatcacgtacacg

SEQ ID NO: 129213 - DNA, 552 bp, Homo sapiens
  Payload ID: 5281
  Gene Symbol: EFEMP1
  Gene Name: EGF containing fibulin-like extracellular matrix protein 1
  ENST ID: ENST00000452337
  CDS Start-End: 368-552
atcagacccacggggctgccctcccctgcgcactcccctcgctgcccgggcccggagcgcagcgcggccgcacaggtatttttgctgtgctgtgcaaggaactctgctagctcaagcgtagcaggatggagtaacgtgaaatgcaattctacagcagtttttacgtctttgctgcctcgttcgttggctaccgagaaggttcaggagggggaggggagatgagaaagcagattggaagttgagtatggtggagcctcagcctctcccaccctcctttcctcgcttgtgctcactgctaaagttttgttactttccccgcagcagatactaaacattagtttgtcctgtattttctttgagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgt

SEQ ID NO: 129214 - DNA, 547 bp, Homo sapiens
  Payload ID: 5281
  Gene Symbol: EFEMP1
  Gene Name: EGF containing fibulin-like extracellular matrix protein 1
  ENST ID: ENST00000421664
  CDS Start-End: 393-547
acttcgccagatcagacccacggggctgccctcccctgcgcactcccctcgctgcccgggcccggagcgcagcgcggccgcacagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaaggttcaggagggggaggggagatgagaaagcagattggaagttgagtatggtggagcctcagcctctcccaccctcctttcctcgcttgtgctcactgctaaagttttgttactttccccgcagcagatactaaacattagtttgtcctgtattttctttgagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtccc

SEQ ID NO: 129215 - DNA, 572 bp, Homo sapiens
  Payload ID: 5281
  Gene Symbol: EFEMP1
  Gene Name: EGF containing fibulin-like extracellular matrix protein 1
  ENST ID: ENST00000439193
  CDS Start-End: 216-572
acttcgccagatcagacccacggggctgccctcccctgcgcactcccctcgctgcccgggcccggagcgcagcgcggccgcacaggtatttttgctgtgctgtgcaaggaactctgctagctcaagcgtagcaggatggagtaacgtgaaatgcaattctacagcagtttttacgtctttgctgcctcgttcgttggctaccgagaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtg

SEQ ID NO: 129216 - DNA, 1007 bp, Homo sapiens
  Payload ID: 5281
  Gene Symbol: EFEMP1
  Gene Name: EGF containing fibulin-like extracellular matrix protein 1
  ENST ID: ENST00000634374
  CDS Start-End: 1-841
aaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgt

SEQ ID NO: 129217 - DNA, 1809 bp, Homo sapiens
  Payload ID: 5281
  Gene Symbol: EFEMP1
  Gene Name: EGF containing fibulin-like extracellular matrix protein 1
  ENST ID: ENST00000635671
  CDS Start-End: 74-214
acggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagaagattcctgacttattttattactgaccacagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttag

SEQ ID NO: 129218 - DNA, 2034 bp, Homo sapiens
  Payload ID: 5282
  Gene Symbol: EFEMP2
  Gene Name: EGF containing fibulin-like extracellular matrix protein 2
  Uniprot ID: O95967
  ENST ID: ENST00000307998
  CDS Start-End: 232-1563
gcggggggtcggggtccctccccctggcgctggctcaggaatccgccgaagggcgggcggaggcgccggggtgggccgcgccgcggcaggcgggcgggcggggggcgcttcctggggccgcgcgtccagggagctgtgccgtccgcccgtccgtctgcccgcaggcattgcccgagccagccgagccgccagagccgcgggccgcgggggtgtcgcgggcccaaccccaggatgctcccctgcgcctcctgcctacccgggtctctactgctctgggcgctgctactgttgctcttgggatcagcttctcctcaggattctgaagagcccgacagctacacggaatgcacagatggctatgagtgggacccagacagccagcactgccgggatgtcaacgagtgtctgaccatccctgaggcctgcaagggggaaatgaagtgcatcaaccactacgggggctacttgtgcctgccccgctccgctgccgtcatcaacgacctacacggcgagggacccccgccaccagtgcctcccgctcaacaccccaacccctgcccaccaggctatgagcccgacgatcaggacagctgtgtggatgtggacgagtgtgcccaggccctgcacgactgtcgccccagccaggactgccataacttgcctggctcctatcagtgcacctgccctgatggttaccgcaagatcgggcccgagtgtgtggacatagacgagtgccgctaccgctactgccagcaccgctgcgtgaacctgcctggctccttccgctgccagtgcgagccgggcttccagctggggcctaacaaccgctcctgtgttgatgtgaacgagtgtgacatgggggccccatgcgagcagcgctgcttcaactcctatgggaccttcctgtgtcgctgccaccagggctatgagctgcatcgggatggcttctcctgcagtgatattgatgagtgtagctactccagctacctctgtcagtaccgctgcatcaacgagccaggccgtttctcctgccactgcccacagggttaccagctgctggccacacgcctctgccaagacattgatgagtgtgagtctggtgcgcaccagtgctccgaggcccaaacctgtgtcaacttccatgggggctaccgctgcgtggacaccaaccgctgcgtggagccctacatccaggtctctgagaaccgctgtctctgcccggcctccaaccctctatgtcgagagcagccttcatccattgtgcaccgctacatgaccatcacctcggagcggagcgtgcccgctgacgtgttccagatccaggcgacctccgtctaccccggtgcctacaatgcctttcagatccgtgctggaaactcgcagggggacttttacattaggcaaatcaacaacgtcagcgccatgctggtcctcgcccggccggtgacgggcccccgggagtacgtgctggacctggagatggtcaccatgaattccctcatgagctaccgggccagctctgtactgaggctcaccgtctttgtaggggcctacaccttctgaggagcaggagggagccaccctccctgcagctaccctagctgaggagcctgttgtgaggggcagaatgagaaaggcaataaagggagaaagaaagtcctggtggctgaggtgggcgggtcacactgcaggaagcctcaggctggggcagggtggcacttgggggggcaggccaagttcacctaaatgggggtctctatatgttcaggcccaggggcccccattgacaggagctgggagctctgcaccacgagcttcagtcaccccgagaggagaggaggtaacgaggagggcggactccaggccccggcccagagatttggacttggctggcttgcaggggtcctaagaaactccactctggacagcgccaggaggccctgggttccattcctaactctgcctcaaactgtacatttggataagccctagtagttccctgggcctgtttttctataaaacgaggcaactgga

SEQ ID NO: 129219 - DNA, 543 bp, Homo sapiens
  Payload ID: 5282
  Gene Symbol: EFEMP2
  Gene Name: EGF containing fibulin-like extracellular matrix protein 2
  ENST ID: ENST00000527277
  CDS Start-End: 1-163
gcaaatcaacaacgtcagcgccatgctggtcctcgcccggccggtgacgggcccccgggagtacgtgctggacctggagatggtcaccatgaattccctcatgagctaccgggccagctctgtactgaggctcaccgtctttgtaggggcctacaccttctgaggagcaggagggagccaccctccctgcagctaccctagctgaggagcctgttgtgaggggcagaatgagaaaggcaataaagggagaaagaaagtcctggtggctgaggcccaggggcccccattgacaggagctgggagctctgcaccacgagcttcagtcaccccgagaggagaggaggtaacgaggagggcggactccaggccccggcccagagatttggacttggctggcttgcaggggtcctaagaaactccactctggacagcgccaggaggccctgggttccattcctaactctgcctcaaactgtacatttggataagccctagtagttccctgggcctgtttttctataaaacgaggcaactggactgtta

SEQ ID NO: 129220 - DNA, 525 bp, Homo sapiens
  Payload ID: 5282
  Gene Symbol: EFEMP2
  Gene Name: EGF containing fibulin-like extracellular matrix protein 2
  ENST ID: ENST00000524408
  CDS Start-End: 1-208
ctttcagatccgtgctggaaactcgcagggggacttttacattaggcaaatcaacaacgtcagcgccatgctggtcctcgcccggccggtgacgggcccccgggagtacgtgctggacctggagatggtcaccatgaattccctcatgagctaccgggccagctctgtactgaggctcaccgtctttgtaggggcctacaccttctgaggagcaggagggagccaccctccctgcagctaccctagctgaggagcctgttgcccaggggcccccattgacaggagctgggagctctgcaccacgagcttcagtcaccccgagaggagaggaggtaacgaggagggcggactccaggccccggcccagagatttggacttggctggcttgcaggggtcctaagaaactccactctggacagcgccaggaggccctgggttccattcctaactctgcctcaaactgtacatttggataagccctagtagttccctgggcctgtttttctataaaacgaggcaactgg

SEQ ID NO: 129221 - DNA, 1504 bp, Homo sapiens
  Payload ID: 5282
  Gene Symbol: EFEMP2
  Gene Name: EGF containing fibulin-like extracellular matrix protein 2
  ENST ID: ENST00000528176
  CDS Start-End: 69-1379
ggcattgcccgagccagccgagccgccagagccgcgggccgcgggggtgtcgcgggcccaaccccaggatgctcccctgcgcctcctgcctacccgggtctctactgctctgggcgctgctactgttgctcttgggatcagcttctcctcaggattctgaagagcccgacagctacacggaatgcacagatggctatgagtgggacccagacagccagcactgccgggatgtcaacgagtgtctgaccatccctgaggcctgcaagggggaaatgaagtgcatcaaccactacgggggctacttgtgcctgccccgctccgctgccgtcatcaacgacctacacggcgagggacccccgccaccagtgcctcccgctcaacaccccaacccctgcccaccaggctatgagcccgacgatcaggacagctgtgtggatgtggacgagtgtgcccaggccctgcacgactgtcgccccagccaggactgccataacttgcctggctcctatcagtgcacctgccctgatggttaccgcaagatcgggcccgagtgtgtggacatagacgagtgccgctaccgctactgccagcaccgctgcgtgaacctgcctggctccttccgctgccagtgcgagccgggcttccagctggggcctaacaaccgctcctgtgttgatgtgaacgagtgtgacatgggggccccatgcgagcagcgctgcttcaactcctatgggaccttcctgtgtcgctgccaccagggctatgagctgcatcgggatggcttctcctgcagtgatattgatgagtgtagctactccagctacctctgtcagtaccgctgcatcaacgagccaggccgtttctcctgccactgcccacagggttaccagctgctggccacacgcctctgccaagacattgatgagtgtgagtctggtgcgcaccagtgctccgaggcccaaacctgtgtcaacttccatgggggctaccgctgcgtggacaccaaccgctgcgtggagccctacatccaggtctctgagaaccgctgtctctgcccggcctccaaccctctatgtcgagagcagccttcatccattgtgcaccgctacatgaccatcacctcggagcggagcgtgcccgctgacgtgttccagatccaggcgacctccgtctaccccggtgcctacaatgcctttcagatccgtgctggaaactcgcagggggacttttacattagggcccaggggcccccattgacaggagctgggagctctgcaccacgagcttcagtcaccccgagaggagaggaggtaacgaggagggcggactccaggccccggcccagagatttggacttggctggcttgcaggggtcctaagaaactccactctggacagcgccaggaggccctgggttccattcctaactctgcctcaaactgtacatttggataagccctagtagttccctgggcctgtttttctataaaacgaggcaactgga

SEQ ID NO: 129222 - DNA, 1813 bp, Homo sapiens
  Payload ID: 5282
  Gene Symbol: EFEMP2
  Gene Name: EGF containing fibulin-like extracellular matrix protein 2
  Uniprot ID: O95967
  ENST ID: ENST00000531972
  CDS Start-End: 137-1468
gggcggggggcgcttcctggggccgcgcgtccagggagctgtgccgtccgcccgtccgtctgcccgcaggcattgcccgagccagccgagccgccagagccgcgggccgcgggggtgtcgcgggcccaaccccaggatgctcccctgcgcctcctgcctacccgggtctctactgctctgggcgctgctactgttgctcttgggatcagcttctcctcaggattctgaagagcccgacagctacacggaatgcacagatggctatgagtgggacccagacagccagcactgccgggatgtcaacgagtgtctgaccatccctgaggcctgcaagggggaaatgaagtgcatcaaccactacgggggctacttgtgcctgccccgctccgctgccgtcatcaacgacctacacggcgagggacccccgccaccagtgcctcccgctcaacaccccaacccctgcccaccaggctatgagcccgacgatcaggacagctgtgtggatgtggacgagtgtgcccaggccctgcacgactgtcgccccagccaggactgccataacttgcctggctcctatcagtgcacctgccctgatggttaccgcaagatcgggcccgagtgtgtggacatagacgagtgccgctaccgctactgccagcaccgctgcgtgaacctgcctggctccttccgctgccagtgcgagccgggcttccagctggggcctaacaaccgctcctgtgttgatgtgaacgagtgtgacatgggggccccatgcgagcagcgctgcttcaactcctatgggaccttcctgtgtcgctgccaccagggctatgagctgcatcgggatggcttctcctgcagtgatattgatgagtgtagctactccagctacctctgtcagtaccgctgcatcaacgagccaggccgtttctcctgccactgcccacagggttaccagctgctggccacacgcctctgccaagacattgatgagtgtgagtctggtgcgcaccagtgctccgaggcccaaacctgtgtcaacttccatgggggctaccgctgcgtggacaccaaccgctgcgtggagccctacatccaggtctctgagaaccgctgtctctgcccggcctccaaccctctatgtcgagagcagccttcatccattgtgcaccgctacatgaccatcacctcggagcggagcgtgcccgctgacgtgttccagatccaggcgacctccgtctaccccggtgcctacaatgcctttcagatccgtgctggaaactcgcagggggacttttacattaggcaaatcaacaacgtcagcgccatgctggtcctcgcccggccggtgacgggcccccgggagtacgtgctggacctggagatggtcaccatgaattccctcatgagctaccgggccagctctgtactgaggctcaccgtctttgtaggggcctacaccttctgaggagcaggagggagccaccctccctgcagctaccctagctgaggagcctgttgtgaggggcagaatgagaaaggcccaggggcccccattgacaggagctgggagctctgcaccacgagcttcagtcaccccgagaggagaggaggtaacgaggagggcggactccaggccccggcccagagatttggacttggctggcttgcaggggtcctaagaaactccactctggacagcgccaggaggccctgggttccattcctaactctgcctcaaactgtacatttggataagccctagtagttccctgggcctgtttttctataaaacgaggcaactggactgtta

SEQ ID NO: 129223 - DNA, 907 bp, Homo sapiens
  Payload ID: 5282
  Gene Symbol: EFEMP2
  Gene Name: EGF containing fibulin-like extracellular matrix protein 2
  ENST ID: ENST00000526624
  CDS Start-End: 301-907
gggcgtgggccggagtctcggccgagtccgcggcagcgtagcgcccacagaggcccgcgctcctcggccttcgccgcaggggcgcggggcgggggcggggtggccggggcgggtgggcctgggacccgggcctgggacctgggcctgtgaggagtcggcccccagccctgggaggccccgaggcccaagcacggtcctgagcgggcagtggcgggggctgggctcgggctcccggtacagggagttgaggtgccgcgggcagaggcccctgacccgtgtccaccatctcgcagccccaggatgctcccctgcgcctcctgcctacccgggtctctactgctctgggcgctgctactgttgctcttgggatcagcttctcctcaggattctgaagagcccgacagctacacggaatgcacagatggctatgagtgggacccagacagccagcactgccgggatgtcaacgagtgtctgaccatccctgaggcctgcaagggggaaatgaagtgcatcaaccactacgggggctacttgtgcctgccccgctccgctgccgtcatcaacgacctacacggcgagggacccccgccaccagtgcctcccgctcaacaccccaacccctgcccaccaggctatgagcccgacgatcaggacagctgtgtggatgtggacgagtgtgcccaggccctgcacgactgtcgccccagccaggactgccataacttgcctggctcctatcagtgcacctgccctgatggttaccgcaagatcgggcccgagtgtgtggacatagacgagtgccgctaccgctactgccagcaccgctgcgtgaacctgcctggctccttccgctgccagtgcgagccgggcttccagctggggcctaacaaccgctcctgtgttg

SEQ ID NO: 129224 - DNA, 1040 bp, Homo sapiens
  Payload ID: 5282
  Gene Symbol: EFEMP2
  Gene Name: EGF containing fibulin-like extracellular matrix protein 2
  ENST ID: ENST00000533347
  CDS Start-End: 268-501
ccgggtaggggcctgtggctggccgggggcggagaagcggggggtcggggtccctccccctggcgctggctcaggaatccgccgaagggcgggcggaggcgccggggtgggccgcgccgcggcaggcgggcgggcggggggcgcttcctggggccgcgcgtccagggagctgtgccgtccgcccgtccgtctgcccgcaggcattgcccgagccagccgagccgccagagccgcgggccgcgggggtgtcgcgggcccaaccccaggatgctcccctgcgcctcctgcctacccgggtctctactgctctgggcgctgctactgttgctcttgggatcagcttctcctcaggattctgaagagcccgacagctacacggaatgcacagatggctatgagtgggacccagacagccagcactgccgggggccagcccaggagactggctgtgcccagcaggcccctctctgcagatgtcaacgagtgtctgaccatccctgaggcctgcaagggggaaatgaagtgcatcaaccactacgggggctacttgtgcctgccccgctccgctgccgtcatcaacgacctacacggcgagggacccccgccaccagtgcctcccgctcaacaccccaacccctgcccaccaggctatgagcccgacgatcaggacagctgtgtggatgtggacgagtgtgcccaggccctgcacgactgtcgccccagccaggactgccataacttgcctggctcctatcagtgcacctgccctgatggttaccgcaagatcgggcccgagtgtgtggacatagacgagtgccgctaccgctactgccagcaccgctgcgtgaacctgcctggctccttccgctgccagtgcgagccgggcttccagctggggcctaacaaccgctcctgtgttgatgtgaacgagtgtgacatgggggccccatgcgagcagcgctgcttcaactcctatgggaccttcctgtgtcgctgccaccagggctatgagctgcatcgggatggcttctcctgcagtg

SEQ ID NO: 129225 - DNA, 614 bp, Homo sapiens
  Payload ID: 5282
  Gene Symbol: EFEMP2
  Gene Name: EGF containing fibulin-like extracellular matrix protein 2
  ENST ID: ENST00000527378
  CDS Start-End: 66-614
gacgctggtgcgaggaggtcgaggaggcgccttggcacccgactctggcatcccgcacccccaggatgctcccctgcgcctcctgcctacccgggtctctactgctctgggcgctgctactgttgctcttgggatcagcttctcctcaggattctgaagagcccgacagctacacggaatgcacagatggctatgagtgggacccagacagccagcactgccgggatgtcaacgagtgtctgaccatccctgaggcctgcaagggggaaatgaagtgcatcaaccactacgggggctacttgtgcctgccccgctccgctgccgtcatcaacgacctacacggcgagggacccccgccaccagtgcctcccgctcaacaccccaacccctgcccaccaggctatgagcccgacgatcaggacagctgtgtggatgtggacgagtgtgcccaggccctgcacgactgtcgccccagccaggactgccataacttgcctggctcctatcagtgcacctgccctgatggttaccgcaagatcgggcccgagtgtgtggacatagacgagtgccgctaccgctactgccagcaccgctgcgtgaacctgcctggctcc

SEQ ID NO: 129226 - DNA, 674 bp, Homo sapiens
  Payload ID: 5282
  Gene Symbol: EFEMP2
  Gene Name: EGF containing fibulin-like extracellular matrix protein 2
  ENST ID: ENST00000531645
  CDS Start-End: 1-549
gatgagtgtgagtctggtgcgcaccagtgctccgaggcccaaacctgtgtcaacttccatgggggctaccgctgcgtggacaccaaccgctgcgtggagccctacatccaggtctctgagaaccgctgtctctgcccggcctccaaccctctatgtcgagagcagccttcatccattgtgcaccgctacatgaccatcacctcggagcggagcgtgcccgctgacgtgttccagatccaggcgacctccgtctaccccggtgcctacaatgcctttcagatccgtgctggaaactcgcagggggacttttacattagggggcctacaccttctgaggagcaggagggagccaccctccctgcagctaccctagctgaggagcctgttgtgaggggcagaatgagaaaggcccaggggcccccattgacaggagctgggagctctgcaccacgagcttcagtcaccccgagaggagaggaggtaacgaggagggcggactccaggccccggcccagagatttggacttggctggcttgcaggggtcctaagaaactccactctggacagcgccaggaggccctgggttccattcctaactctgcctcaaactgtacatttggataagccctagtagttccctgggcctgtttttctataaaacgaggcaactgga

SEQ ID NO: 129227 - DNA, 408 bp, Homo sapiens
  Payload ID: 5282
  Gene Symbol: EFEMP2
  Gene Name: EGF containing fibulin-like extracellular matrix protein 2
  ENST ID: ENST00000530806
  CDS Start-End: 179-408
agctgctggccacacgcctctgccaagacattgatgagtgtgagtctggtgcgcaccagtgctccgaggcccaaacctgtgtcaacttccatgggggctaccgctgcgtggacaccaaccgctgcgtggagccctacatccaggtctctgagaaccttcatccattgtgcaccgctacatgaccatcacctcggagcggagcgtgcccgctgacgtgttccagatccaggcgacctccgtctaccccggtgcctacaatgcctttcagatccgtgctggaaactcgcagggggacttttacattaggcaaatcaacaacgtcagcgccatgctggtcctcgcccggccggtgacgggcccccgggagtacgtgctggacctggagatggtcaccatgaattccctcat

SEQ ID NO: 129228 - DNA, 472 bp, Homo sapiens
  Payload ID: 5282
  Gene Symbol: EFEMP2
  Gene Name: EGF containing fibulin-like extracellular matrix protein 2
  ENST ID: ENST00000526911
  CDS Start-End: 1-225
tccattgtgcaccgctacatgaccatcacctcggagcggagcgtgcccgctgacgtgttccagatccaggcgacctccgtctaccccggtgcctacaatgcctttcagatccgtgctggaaactcgcagggggacttttacattaggcaaatcaacaacgtcagcgccatgctggtcctcgcccggccggtgacgggcccccgggagcccaggggcccccattgacaggagctgggagctctgcaccacgagcttcagtcaccccgagaggagaggaggtaacgaggagggcggactccaggccccggcccagagatttggacttggctggcttgcaggggtcctaagaaactccactctggacagcgccaggaggccctgggttccattcctaactctgcctcaaactgtacatttggataagccctagtagttccctgggcctgtttttctataaaacgaggcaactgga

SEQ ID NO: 129229 - DNA, 566 bp, Homo sapiens
  Payload ID: 5282
  Gene Symbol: EFEMP2
  Gene Name: EGF containing fibulin-like extracellular matrix protein 2
  ENST ID: ENST00000530850
  CDS Start-End: 66-242
attgcccgagccagccgagccgccagagccgcgggccgcgggggtgtcgcgggcccaaccccaggatgctcccctgcgcctcctgcctacccgggtctctactgctctgggcgctgctactgttgctcttgggatcagcttctcctcaggattctgaagagcccgacagctacacggtggggacagtgagggccgctggcctgggacaggaaggatgtcaacgagtgtctgaccatccctgaggcctgcaagggggaaatgaagtgcatcaaccactacgggggctacttgtgcctgccccgctccgctgccgtcatcaacgacctacacggcgagggacccccgccaccagtgcctcccgctcaacaccccaacccctgcccaccaggctatgagcccgacgatcaggacagctgtgtggatgtggacgagtgtgcccaggccctgcacgactgtcgccccagccaggactgccataacttgcctggctcctatcagtgcacctgccctgatggttaccgcaagatcgggcccgagtgtgtggacatagacgagtgccgctaccg

SEQ ID NO: 129230 - DNA, 4138 bp, Homo sapiens
  Payload ID: 5283
  Gene Symbol: EOGT
  Gene Name: EGF domain-specific O-linked N-acetylglucosamine (GlcNAc) transferase
  Uniprot ID: Q5NDL2
  ENST ID: ENST00000295571
  CDS Start-End: 406-1737
gccgtctcctccgcctcctcctcggtagttcacggctgccccggctccaggcctgtggaaatcgaatcaagggtttctggagtggagtgattccagctgctttgagctgaaggaaaagtagcctggccagtaaagcgtccgtgtgctggaggagtgcagccacccatcccggcgggccttgcaggacgaccgacaccaggaaggctttgtgccaggcccagcagccacccccagccgccttatgcaagtgggtacatgccctcgccagacgccagctttctgatctgcgtctttagattttttccatcgcctaagcgttacttctccactgatcggttttagagacctgaaacatcacagaagcttctgagtggttctgaagattcaagaggtttgcaggttgctatgttaatgttgtttgtctttggagtcttacttcatgaagtctcactgagtggtcagaatgaagctcctcctaatactcacagcattccaggcgaacctctgtataactatgccagcatccgcttgccagaggagcacattcccttctttttgcacaacaataggcatattgccactgtctgtaggaaagactctctttgtccatataagaaacacctagagaagctaaagtactgctggggttatgagaaatcctgcaaaccagagttcaggtttggttacccagtttgcagctatgtcgacatgggatggacggacactcttgagtcagctgaggacatattttggaaacaagctgactttggatatgccagagagaggctggaggagatgcatgtgctctgtcagcctaaggaaacgagtgactcaagtctggtgtgttcccgttatcttcagtactgcagagcaaccaatctctatcttgatttaagaaacatcaagagaaatcatgacagatttaaggaggactttttccagagtggtgaaattggagggcactgtaaacttgacatccgtacattgacgtctgaaggtcagcgcaaaagccctctgcagtcatggtttgctgagctacaaagctatactcagctcaacttcagacctatagaagatgctaaatgtgacattgtcattgaaaaaccaacatatttcatgaaattagatgcaggtgttaacatgtatcaccacttctgtgatttcatcaatctttatattactcagcacgttaataactcattcagtactgacgtgtacatcgtgatgtgggacaccgatggaaaaattcgagtcaccattcttgcacggagcacagaataccggaaaatccttaaccaaaatgagcttgtaaatgcactgaaaacagtatctacatttgaagtccagattgttgattacaagtatagagaacttgggtttttagatcaactaaggatcacacacaacacggacatatttattggaatgcatggagctggtctgacccatttacttttccttccagactgggctgctgtatttgaactgtacaactgtgaagatgaacgctgttacttagacttggccaggctgagaggcgttcactacatcacttggcgacggcagaacaaagtctttcctcaggataagggccaccatccaaccctgggggagcacccgaagttcaccaactactctttcgatgtagaagaatttatgtatcttgtccttcaggctgcagaccacgtattgcaacacccaaagtggccatttaagaagaaacatgatgagctataaatatgctgagtctgtttgcaaaaagagagtgtttaaacactccaacacccagacttagaattaaatcagtaaagcaatctgttatttcctatccccgaattaccttttctatgccaaaacataccttcaggatattgttatgtgttgtatagatgttaagtgtttcatgtggtttttgtgtcattgctatttatcaatagcaataattttgcactgaaaactttttatagttcaaaaattaagcatggactccccagtatactttaactttctttctttctttttttttttttggagacagagtctcactgtcacccaggctggagtgcagtggcatgatctcagtttatgcaacttctgcctccccaggttcaagcgattcttttgcctcagccacctgactagctgggattgcagcctgcaccaccacacctggctaaatttttgttgttgtcgttgagatacagtttcactctgtcacccaggctggagtgcagtggcatgatctcagctcactgcaacctctgccttctggattcaagtgattcttgtgccttagcctcccaagtagctgggattacaggcgtgcaccaccacgcccagttgatttttgtatttttgatagagacggagtttcaccatgttggccaggctggtctcgaactctgggttcaagaaatcctcccaccttgcctcccaaagtgctgggattacaggtgtgagccaccacgcatggccctgaactttctctttttaggaataccaaagttttcaactttttcagctttagaatttgtaaatatttttgtagaatatcatatgactgtaattccagagtgttccaacttgtttatgatatatttgggtaaatttacaactgttcttttatttgccataatctggttataacactgtttgtggtaggaaaggaaaacatgcaaaacatacacacacacacacacacacacacacacacgcagagttgtgattctcagtaccaagctataggaccatgttatagatcagcgtttagtcacctccaggttatatgcatcgagaacctgaataaatcatgccactatattaatttatattacatgtttcatatttaaatcatgttttcctaaaatgtagcaactacatgtgataaaagcaaattagaacattctgtaggactgtcttgcataccttctgtctggtttccactgattccttcttagccatggagagcatttgtgattaattaatttatatatgaaataatggtttccattttatgcgagtatttgtaactgcatataccagtgcgtgtgcgtctacctctgtcagcatgaaagtattccagtctttaatttcaaaaacttcaaattagcctcatgaagagaatttttccctgtgaaaagtaagaccaagaaaaaacaaactaaagacatgtgacttattcaatgaaagtgaaaaagaagctctaaaacagtgtcattgattaaaaagaatatctggaatgtagccccactctttgagtgggattcatttcttactgcttatgaactttcaatttagtagtcagaaaccatggatttattttactgcacaatgtgaagtttacattttattaacacttgagtagtctgatttagagactagttacttctattttttaaaataatggagtaacaaattacagaatagctaaataattttttaaaaatattttacagttgtaaaaaatatccatcagaaaaatgacacacaaaacaaaatatctggacctttacagaagacgtttgctgacccccactttaaaggattggaacagtcttctagaattgaggaatatttattaaaatacctgtaaagaaaatagtgaatcactgtagcaatggctttgattcagaccttaaaatcacataagaagaattacaacatgttatggatttttaagtggcaggtattgtaactgttttttgtgtgcaaaatactgagtaaccactgggaaaatatttcagatgaaagggatgacaaaagcatgttgcgctttgcatcagcaaggcattgacttctgaaaaaatgatctgaaaaaagtttcaccgtttgtcttcttacctcattttaagaagcatgtgaaaatgggatactatagactactgagaatttcagaaattgagaacaatttcataataaaacggctatatttgaagagagaatacattttatataaacaggaaaatacatttgacactttatggaattttatgagactttttgtgggaacagaaggtcttcaaattgtaaaatgtaaagattgctctttttattaagtctttaacagggatgtatttcattgtatgttttgggtatggctttggaataaatcattttatattttatttgaatatcagaa

SEQ ID NO: 129231 - DNA, 4731 bp, Homo sapiens
  Payload ID: 5283
  Gene Symbol: EOGT
  Gene Name: EGF domain-specific O-linked N-acetylglucosamine (GlcNAc) transferase
  Uniprot ID: Q5NDL2
  ENST ID: ENST00000383701
  CDS Start-End: 744-2327
ctttccggccctggtgagggagctggcggactcgcgcgaacgttcgcgggagaacgccaggaagggcagatggttcctcgactctgagcccctccctgctgcgctcgccgggtcgaggccgctcgccgggctgaagccgctccgagcgtcgggccccgcgccctggccctcctgggtgtagtcccggtcctgcctctgcggggcccgagcccgcccacggcgccggctggccaaggtgtcccagctgctccttggcgccccctggcccagctcccgcgcccgaggtttccggtgagcggcagtagccggttatgacgactccctcctctggaacagccgccgtctcctccgcctcctcctcggtagttcacggctgccccggctccaggcctgtggaaatcgaatcaagggtttctggagtggagtgattccagctgctttgagctgaaggaaaagtagcctggccagtaaagcgtccgtgtgctggaggagtgcagccacccatcccggcgggccttgcaggacgaccgacaccaggaaggctttgtgccaggcccagcagccacccccagccgccttatgcaagtgggtacatgccctcgccagacgccagctttctgatctgcgtctttagattttttccatcgcctaagcgttacttctccactgatcggttttagagacctgaaacatcacagaagcttctgagtggttctgaagattcaagaggtttgcaggttgctatgttaatgttgtttgtctttggagtcttacttcatgaagtctcactgagtggtcagaatgaagctcctcctaatactcacagcattccaggcgaacctctgtataactatgccagcatccgcttgccagaggagcacattcccttctttttgcacaacaataggcatattgccactgtctgtaggaaagactctctttgtccatataagaaacacctagagaagctaaagtactgctggggttatgagaaatcctgcaaaccagagttcaggtttggttacccagtttgcagctatgtcgacatgggatggacggacactcttgagtcagctgaggacatattttggaaacaagctgactttggatatgccagagagaggctggaggagatgcatgtgctctgtcagcctaaggaaacgagtgactcaagtctggtgtgttcccgttatcttcagtactgcagagcaaccaatctctatcttgatttaagaaacatcaagagaaatcatgacagatttaaggaggactttttccagagtggtgaaattggagggcactgtaaacttgacatccgtacattgacgtctgaaggtcagcgcaaaagccctctgcagtcatggtttgctgagctacaaagctatactcagctcaacttcagacctatagaagatgctaaatgtgacattgtcattgaaaaaccaacatatttcatgaaattagatgcaggtgttaacatgtatcaccacttctgtgatttcatcaatctttatattactcagcacgttaataactcattcagtactgacgtgtacatcgtgatgtgggacaccagttcttacggatatggtgacctattctccgacacatggaatgcatttactgattatgacgttatacatttgaaaacttatgattccaaaagggtatgttttaaagaagctgttttttcattactcccccgcatgaggtatgggctgttctataatactcctctgatatctggctgtcaaaatactggactattcagggcatttgcccagcatgtactacacagactaaacatcacacaagaaggacctaaggatggaaaaattcgagtcaccattcttgcacggagcacagaataccggaaaatccttaaccaaaatgagcttgtaaatgcactgaaaacagtatctacatttgaagtccagattgttgattacaagtatagagaacttgggtttttagatcaactaaggatcacacacaacacggacatatttattggaatgcatggagctggtctgacccatttacttttccttccagactgggctgctgtatttgaactgtacaactgtgaagatgaacgctgttacttagacttggccaggctgagaggcgttcactacatcacttggcgacggcagaacaaagtctttcctcaggataagggccaccatccaaccctgggggagcacccgaagttcaccaactactctttcgatgtagaagaatttatgtatcttgtccttcaggctgcagaccacgtattgcaacacccaaagtggccatttaagaagaaacatgatgagctataaatatgctgagtctgtttgcaaaaagagagtgtttaaacactccaacacccagacttagaattaaatcagtaaagcaatctgttatttcctatccccgaattaccttttctatgccaaaacataccttcaggatattgttatgtgttgtatagatgttaagtgtttcatgtggtttttgtgtcattgctatttatcaatagcaataattttgcactgaaaactttttatagttcaaaaattaagcatggactccccagtatactttaactttctttctttctttttttttttttggagacagagtctcactgtcacccaggctggagtgcagtggcatgatctcagtttatgcaacttctgcctccccaggttcaagcgattcttttgcctcagccacctgactagctgggattgcagcctgcaccaccacacctggctaaatttttgttgttgtcgttgagatacagtttcactctgtcacccaggctggagtgcagtggcatgatctcagctcactgcaacctctgccttctggattcaagtgattcttgtgccttagcctcccaagtagctgggattacaggcgtgcaccaccacgcccagttgatttttgtatttttgatagagacggagtttcaccatgttggccaggctggtctcgaactctgggttcaagaaatcctcccaccttgcctcccaaagtgctgggattacaggtgtgagccaccacgcatggccctgaactttctctttttaggaataccaaagttttcaactttttcagctttagaatttgtaaatatttttgtagaatatcatatgactgtaattccagagtgttccaacttgtttatgatatatttgggtaaatttacaactgttcttttatttgccataatctggttataacactgtttgtggtaggaaaggaaaacatgcaaaacatacacacacacacacacacacacacacacacgcagagttgtgattctcagtaccaagctataggaccatgttatagatcagcgtttagtcacctccaggttatatgcatcgagaacctgaataaatcatgccactatattaatttatattacatgtttcatatttaaatcatgttttcctaaaatgtagcaactacatgtgataaaagcaaattagaacattctgtaggactgtcttgcataccttctgtctggtttccactgattccttcttagccatggagagcatttgtgattaattaatttatatatgaaataatggtttccattttatgcgagtatttgtaactgcatataccagtgcgtgtgcgtctacctctgtcagcatgaaagtattccagtctttaatttcaaaaacttcaaattagcctcatgaagagaatttttccctgtgaaaagtaagaccaagaaaaaacaaactaaagacatgtgacttattcaatgaaagtgaaaaagaagctctaaaacagtgtcattgattaaaaagaatatctggaatgtagccccactctttgagtgggattcatttcttactgcttatgaactttcaatttagtagtcagaaaccatggatttattttactgcacaatgtgaagtttacattttattaacacttgagtagtctgatttagagactagttacttctattttttaaaataatggagtaacaaattacagaatagctaaataattttttaaaaatattttacagttgtaaaaaatatccatcagaaaaatgacacacaaaacaaaatatctggacctttacagaagacgtttgctgacccccactttaaaggattggaacagtcttctagaattgaggaatatttattaaaatacctgtaaagaaaatagtgaatcactgtagcaatggctttgattcagaccttaaaatcacataagaagaattacaacatgttatggatttttaagtggcaggtattgtaactgttttttgtgtgcaaaatactgagtaaccactgggaaaatatttcagatgaaagggatgacaaaagcatgttgcgctttgcatcagcaaggcattgacttctgaaaaaatgatctgaaaaaagtttcaccgtttgtcttcttacctcattttaagaagcatgtgaaaatgggatactatagactactgagaatttcagaaattgagaacaatttcataataaaacggctatatttgaagagagaatacattttatataaacaggaaaatacatttgacactttatggaattttatgagactttttgtgggaacagaaggtcttcaaattgtaaaatgtaaagattgctctttttattaagtctttaacagggatgtatttcattgtatgttttgggtatggctttggaataaatcattttatattttatttgaatatcagaacca

SEQ ID NO: 129232 - DNA, 2243 bp, Homo sapiens
  Payload ID: 5283
  Gene Symbol: EOGT
  Gene Name: EGF domain-specific O-linked N-acetylglucosamine (GlcNAc) transferase
  ENST ID: ENST00000403140
  CDS Start-End: 433-1053
atgacgactccctcctctggaacagccgccgtctcctccgcctcctcctcggtagttcacggctgccccggctccaggcctgtggaaatcgaatcaagggtttctggagtggagtgattccagctgctttgagctgaaggaaaagtagcctggccagtaaagcgtccgtgtgctggaggagtgcagccacccatcccggcgggccttgcaggacgaccgacaccaggaaggctttgtgccaggcccagcagccacccccagccgccttatgcaagtgggtacatgccctcgccagacgccagctttctgatctgcgtctttagattttttccatcgcctaagcgttacttctccactgatcggttttagagacctgaaacatcacagaagcttctgagtggttctgaagattcaagaggtttgcaggttgctatgttaatgttgtttgtctttggagtcttacttcatgaagtctcactgagtggtcagaatgaagctcctcctaatactcacagcattccaggcgaacctctgtataactatgccagcatccgcttgccagaggagcacattcccttctttttgcacaacaataggcatattgccactgtctgtaggaaagactctctttgtccatataagaaacacctagagaagctaaagtactgctggggttatgagaaatcctgcaaaccagagttcaggtttggttacccagtttgcagctatgtcgacatgggatggacggacactcttgagtcagctgaggacatattttggaaacaagctgactttggatatgccagagagaggctggaggagatgcatgtgctctgtcagcctaaggaaacgagtgactcaagtctggtgtgttcccgttatcttcagtactgcagagcaaccaatctctatcttgatttaagaaacatcaagagaaatcatgacagatttaaggaggactttttccagagtggtgaaattggagggcactgtaaacttgacatccgtacattgacgtctgaaggtcagcgcaaaagccctctgcagtcatgagttcttacggatatggtgacctattctccgacacatggaatgcatttactgattatgacgttatacatttgaaaacttatgattccaaaagggtatgttttaaagaagctgttttttcattactcccccgcatgaggtatgggctgttctataatactcctctgatatctggctgtcaaaatactggactattcagggcatttgcccagcatgtactacacagactaaacatcacacaagaaggacctaaggatggaaaaattcgagtcaccattcttgcacggagcacagaataccggaaaatccttaaccaaaatgagcttgtaaatgcactgaaaacagtatctacatttgaagtccagattgttgattacaagtatagagaacttgggtttttagatcaactaaggatcacacacaacacggacatatttattggaatgcatggagctggtctgacccatttacttttccttccagactgggctgctgtatttgaactgtacaactgtgaagatgaacgctgttacttagacttggccaggctgagaggcgttcactacatcacttggcgacggcagaacaaagtctttcctcaggataagggccaccatccaaccctgggggagcacccgaagttcaccaactactctttcgatgtagaagaatttatgtatcttgtccttcaggctgcagaccacgtattgcaacacccaaagtggccatttaagaagaaacatgatgagctataaatatgctgagtctgtttgcaaaaagagagtgtttaaacactccaacacccagacttagaattaaatcagtaaagcaatctgttatttcctatccccgaattaccttttctatgccaaaacataccttcaggatattgttatgtgttgtatagatgttaagtgtttcatgtggtttttgtgtcattgctatttatcaatagcaataattttgcactgaaaactttttatagttcaaaaattaagcatggactccccagtatactttaactttctttctttctttttttttttttggagacagagtctcactgtcacccaggctggagtgcagtggcatgatctcagtttatgcaacttctgcctccccaggttcaagcgattcttttgcctcagccacctgactagctgggattgcagcctgcaccaccacacctggct

SEQ ID NO: 129233 - DNA, 924 bp, Homo sapiens
  Payload ID: 5283
  Gene Symbol: EOGT
  Gene Name: EGF domain-specific O-linked N-acetylglucosamine (GlcNAc) transferase
  ENST ID: ENST00000424374
  CDS Start-End: 529-924
gtagttcacggctgccccggctccaggcctgtggaaatcgaatcaagggtttctggagtggagtgattccagctgctttgagctgaaggaaaagtagcctggccagtaaagcgtccgtgtgctggaggagtgcagccacccatcccggcgggccttgcaggacgaccgacaccaggaaggctttgtgccaggcccagcagccacccccagccgccttatgcaagtgggtacatgccctcgccagacgccagctttctgatctgcgtctttagattttttccatcgcctaagcgttacttctccactgatcggtgagtttagtgatggccagagctcactggaggacaatggacttggataaccaaaggtcagggcttggtcataacaatgactttattaccgggaaggacgagtcaaaaaataggaaggcctgggaaccctcaggctcgccactctaggttttagagacctgaaacatcacagaagcttctgagtggttctgaagattcaagaggtttgcaggttgctatgttaatgttgtttgtctttggagtcttacttcatgaagtctcactgagtggtcagaatgaagctcctcctaatactcacagcattccaggcgaacctctgtataactatgccagcatccgcttgccagaggagcacattcccttctttttgcacaacaataggcatattgccactgtctgtaggaaagactctctttgtccatataagaaacacctagagaagctaaagtactgctggggttatgagaaatcctgcaaaccagagttcaggtttggttacccagtttgcagctatgtcgacatgggatggacggacactcttgagtcagctgaggacatattttggaaacaagctgactttggatatgccagagagaggctggaggagatgcat

SEQ ID NO: 129234 - DNA, 736 bp, Homo sapiens
  Payload ID: 5283
  Gene Symbol: EOGT
  Gene Name: EGF domain-specific O-linked N-acetylglucosamine (GlcNAc) transferase
  ENST ID: ENST00000456376
  CDS Start-End: 366-736
ggtgagcggcagtagccggttatgacgactccctcctctggaacagccgccgtctcctccgcctcctcctcggtagttcacggctgccccggctccaggcctgtggaaatcgaatcaagggtttctggagtggagtgattccagctgctttgagctgaaggaaaagtagcctggccagtaaagcgtccgtgtgctggaggagtgcagccacccatcccggcgggccttgcaggacgaccgacaccaggaaggctttgtgccaggcccagcagccacccccagccgccttatgcaagttttagagacctgaaacatcacagaagcttctgagtggttctgaagattcaagaggtttgcaggttgctatgttaatgttgtttgtctttggagtcttacttcatgaagtctcactgagtggtcagaatgaagctcctcctaatactcacagcattccaggcgaacctctgtataactatgccagcatccgcttgccagaggagcacattcccttctttttgcacaacaataggcatattgccactgtctgtaggaaagactctctttgtccatataagaaacacctagagaagctaaagtactgctggggttatgagaaatcctgcaaaccagagttcaggtttggttacccagtttgcagctatgtcgacatgggatggacggacactcttgagtcagctgaggacatattttggaaacaagctgactttggatatgc

SEQ ID NO: 129235 - DNA, 1584 bp, Homo sapiens
  Payload ID: 5283
  Gene Symbol: EOGT
  Gene Name: EGF domain-specific O-linked N-acetylglucosamine (GlcNAc) transferase
  Uniprot ID: Q5NDL2
  ENST ID: ENST00000540764
  CDS Start-End: 1-1584
atgttaatgttgtttgtctttggagtcttacttcatgaagtctcactgagtggtcagaatgaagctcctcctaatactcacagcattccaggcgaacctctgtataactatgccagcatccgcttgccagaggagcacattcccttctttttgcacaacaataggcatattgccactgtctgtaggaaagactctctttgtccatataagaaacacctagagaagctaaagtactgctggggttatgagaaatcctgcaaaccagagttcaggtttggttacccagtttgcagctatgtcgacatgggatggacggacactcttgagtcagctgaggacatattttggaaacaagctgactttggatatgccagagagaggctggaggagatgcatgtgctctgtcagcctaaggaaacgagtgactcaagtctggtgtgttcccgttatcttcagtactgcagagcaaccaatctctatcttgatttaagaaacatcaagagaaatcatgacagatttaaggaggactttttccagagtggtgaaattggagggcactgtaaacttgacatccgtacattgacgtctgaaggtcagcgcaaaagccctctgcagtcatggtttgctgagctacaaagctatactcagctcaacttcagacctatagaagatgctaaatgtgacattgtcattgaaaaaccaacatatttcatgaaattagatgcaggtgttaacatgtatcaccacttctgtgatttcatcaatctttatattactcagcacgttaataactcattcagtactgacgtgtacatcgtgatgtgggacaccagttcttacggatatggtgacctattctccgacacatggaatgcatttactgattatgacgttatacatttgaaaacttatgattccaaaagggtatgttttaaagaagctgttttttcattactcccccgcatgaggtatgggctgttctataatactcctctgatatctggctgtcaaaatactggactattcagggcatttgcccagcatgtactacacagactaaacatcacacaagaaggacctaaggatggaaaaattcgagtcaccattcttgcacggagcacagaataccggaaaatccttaaccaaaatgagcttgtaaatgcactgaaaacagtatctacatttgaagtccagattgttgattacaagtatagagaacttgggtttttagatcaactaaggatcacacacaacacggacatatttattggaatgcatggagctggtctgacccatttacttttccttccagactgggctgctgtatttgaactgtacaactgtgaagatgaacgctgttacttagacttggccaggctgagaggcgttcactacatcacttggcgacggcagaacaaagtctttcctcaggataagggccaccatccaaccctgggggagcacccgaagttcaccaactactctttcgatgtagaagaatttatgtatcttgtccttcaggctgcagaccacgtattgcaacacccaaagtggccatttaagaagaaacatgatgagctataa

SEQ ID NO: 129236 - DNA, 1332 bp, Homo sapiens
  Payload ID: 5283
  Gene Symbol: EOGT
  Gene Name: EGF domain-specific O-linked N-acetylglucosamine (GlcNAc) transferase
  Uniprot ID: Q5NDL2
  ENST ID: ENST00000540955
  CDS Start-End: 1-1332
atgttaatgttgtttgtctttggagtcttacttcatgaagtctcactgagtggtcagaatgaagctcctcctaatactcacagcattccaggcgaacctctgtataactatgccagcatccgcttgccagaggagcacattcccttctttttgcacaacaataggcatattgccactgtctgtaggaaagactctctttgtccatataagaaacacctagagaagctaaagtactgctggggttatgagaaatcctgcaaaccagagttcaggtttggttacccagtttgcagctatgtcgacatgggatggacggacactcttgagtcagctgaggacatattttggaaacaagctgactttggatatgccagagagaggctggaggagatgcatgtgctctgtcagcctaaggaaacgagtgactcaagtctggtgtgttcccgttatcttcagtactgcagagcaaccaatctctatcttgatttaagaaacatcaagagaaatcatgacagatttaaggaggactttttccagagtggtgaaattggagggcactgtaaacttgacatccgtacattgacgtctgaaggtcagcgcaaaagccctctgcagtcatggtttgctgagctacaaagctatactcagctcaacttcagacctatagaagatgctaaatgtgacattgtcattgaaaaaccaacatatttcatgaaattagatgcaggtgttaacatgtatcaccacttctgtgatttcatcaatctttatattactcagcacgttaataactcattcagtactgacgtgtacatcgtgatgtgggacaccgatggaaaaattcgagtcaccattcttgcacggagcacagaataccggaaaatccttaaccaaaatgagcttgtaaatgcactgaaaacagtatctacatttgaagtccagattgttgattacaagtatagagaacttgggtttttagatcaactaaggatcacacacaacacggacatatttattggaatgcatggagctggtctgacccatttacttttccttccagactgggctgctgtatttgaactgtacaactgtgaagatgaacgctgttacttagacttggccaggctgagaggcgttcactacatcacttggcgacggcagaacaaagtctttcctcaggataagggccaccatccaaccctgggggagcacccgaagttcaccaactactctttcgatgtagaagaatttatgtatcttgtccttcaggctgcagaccacgtattgcaacacccaaagtggccatttaagaagaaacatgatgagctataa

SEQ ID NO: 129237 - DNA, 1931 bp, Homo sapiens
  Payload ID: 5283
  Gene Symbol: EOGT
  Gene Name: EGF domain-specific O-linked N-acetylglucosamine (GlcNAc) transferase
  ENST ID: ENST00000615922
  CDS Start-End: 42-449
gatacagtttcactctgtcacccaggctggagtgcagtggcatgatctcagctcactgcaacctctgccttctggattcaagtgattcttgtgccttagcctcccaagtagctgggattacaggcgtgcaccaccacgcccagttgatttttgtatttttgatagagacggagtttcaccatgttggccaggctggtctcgaactctgggttcaagaaatcctcccaccttgcctcccaaagtgctgggattacaggtgtgagccaccacgcatggccctgaactttctctttttaggaataccaaagttttcaactttttcagctttagaatttgtaaatatttttgtagaatatcatatgactgtaattccagagtgttccaacttgtttatgatatatttgggtaaatttacaactgttcttttatttgccataatctggttataacactgtttgtggtaggaaaggaaaacatgcaaaacatacacacacacacacacacacacacacacacgcagagttgtgattctcagtaccaagctataggaccatgttatagatcagcgtttagtcacctccaggttatatgcatcgagaacctgaataaatcatgccactatattaatttatattacatgtttcatatttaaatcatgttttcctaaaatgtagcaactacatgtgataaaagcaaattagaacattctgtaggactgtcttgcataccttctgtctggtttccactgattccttcttagccatggagagcatttgtgattaattaatttatatatgaaataatggtttccattttatgcgagtatttgtaactgcatataccagtgcgtgtgcgtctacctctgtcagcatgaaagtattccagtctttaatttcaaaaacttcaaattagcctcatgaagagaatttttccctgtgaaaagtaagaccaagaaaaaacaaactaaagacatgtgacttattcaatgaaagtgaaaaagaagctctaaaacagtgtcattgattaaaaagaatatctggaatgtagccccactctttgagtgggattcatttcttactgcttatgaactttcaatttagtagtcagaaaccatggatttattttactgcacaatgtgaagtttacattttattaacacttgagtagtctgatttagagactagttacttctattttttaaaataatggagtaacaaattacagaatagctaaataattttttaaaaatattttacagttgtaaaaaatatccatcagaaaaatgacacacaaaacaaaatatctggacctttacagaagacgtttgctgacccccactttaaaggattggaacagtcttctagaattgaggaatatttattaaaatacctgtaaagaaaatagtgaatcactgtagcaatggctttgattcagaccttaaaatcacataagaagaattacaacatgttatggatttttaagtggcaggtattgtaactgttttttgtgtgcaaaatactgagtaaccactgggaaaatatttcagatgaaagggatgacaaaagcatgttgcgctttgcatcagcaaggcattgacttctgaaaaaatgatctgaaaaaagtttcaccgtttgtcttcttacctcattttaagaagcatgtgaaaatgggatactatagactactgagaatttcagaaattgagaacaatttcataataaaacggctatatttgaagagagaatacattttatataaacaggaaaatacatttgacactttatggaattttatgagactttttgtgggaacagaaggtcttcaaattgtaaaatgtaaagattgctctttttattaagtctttaacagggatgtatttcattgtatgttttgggtatggctttggaataaatcattttatattttatttg

SEQ ID NO: 129238 - DNA, 4727 bp, Homo sapiens
  Payload ID: 5284
  Gene Symbol: EDIL3
  Gene Name: EGF-like repeats and discoidin I-like domains 3
  Uniprot ID: O43854
  ENST ID: ENST00000296591
  CDS Start-End: 420-1862
agaagccccgcagccgccgcgcggagaacagcgacagccgagcgcccggtccgcctgtctgccggtgggtctgcctgcccgcgcagcagacccggggcggccgcgggagcccgcgccccgcccgccgcgcctctgccgggacccacccgcagcggagggctgagcccgccggcggctccccggagctcacccacctccgcgcgccggagcgcaggcaaaaggggaggaaaggctcctctctttagtcaccactctcgccctctccaagaatttgtttaacaaagcgctgaggaaagagaacgtcttcttgaattctttagtaggggcggagtctgctgctgccctgcgctgccacctcggctacactgccctccgcgacgacccctgaccagccggggtcacgtccgggagacgggatcatgaagcgctcggtagccgtctggctcttggtcgggctcagcctcggtgtcccccagttcggcaaaggtgatatttgtgatcccaatccatgtgaaaatggaggtatctgtttgccaggattggctgatggttccttttcctgtgagtgtccagatggcttcacagaccccaactgttctagtgttgtggaggttgcatcagatgaagaagaaccaacttcagcaggtccctgcactcctaatccatgccataatggaggaacctgtgaaataagtgaagcataccgaggggatacattcataggctatgtttgtaaatgtccccgaggatttaatgggattcactgtcagcacaacataaatgaatgcgaagttgagccttgcaaaaatggtggaatatgtacagatcttgttgctaactattcctgtgagtgcccaggcgaatttatgggaagaaattgtcaatacaaatgctcaggcccactgggaattgaaggtggaattatatcaaaccagcaaatcacagcttcctctactcaccgagctctttttggactccaaaaatggtatccctactatgcacgtcttaataagaaggggcttataaatgcgtggacagctgcagaaaatgacagatggccgtggattcagataaatttgcaaaggaaaatgagagttactggtgtgattacccaaggagccaagaggattggaagcccagagtatataaaatcctacaaaattgcctacagtaatgatggaaagacttgggcaatgtacaaagtgaaaggcaccaatgaagacatggtgtttcgtggaaacattgataacaacactccatatgctaactctttcacaccccccataaaagctcagtatgtaagactctatccccaagtttgtcgaagacattgcactttgcgaatggaacttcttggctgtgaactgtcgggttgttctgagcctctgggtatgaaatcaggacatatacaagactatcagatcactgcctccagcatcttcagaacgctcaacatggacatgttcacttgggaaccaaggaaagctcggctggacaagcaaggcaaagtgaatgcctggacctctggccacaatgaccagtcacaatggttacaggtggatcttcttgttccaaccaaagtgactggcatcattacacaaggagctaaagattttggtcatgtacagtttgttggctcctacaaactggcttacagcaatgatggagaacactggactgtataccaggatgaaaagcaaagaaaagataaggttttccagggaaattttgacaatgacactcacagaaaaaatgtcatcgaccctcccatctatgcacgacacataagaatccttccttggtcctggtacgggaggatcacattgcggtcagagctgctgggctgcacagaggaggaatgaggggaggctacatttcacaaccctcttccctatttccctaaaagtatctccatggaatgaactgtgcaaaatctgtaggaaactgaatggtttttttttttttttcatgaaaaagtgctcaaattatggtaggcaactaacggtgtttttaagggggtctaagcctgccttttcaatgatttaatttgattttattttatccgtcaaatctcttaagtaacaacacattaagtgtgaattacttttctctcattgtttcctgaattattcgcattggtagaaatatattagggaaagaaagtagccttctttttatagcaagagtaaaaaagtctcaaagtcatcaaataagagcaagagttgatagagcttttacaatcaatactcacctaattctgataaaaggaatactgcaatgttagcaataagtttttttcttctgtaatgactctacgttatcctgtttccctgtgcctaccaaacactgtcaatgtttattacaaaattttaaagaagaatatgtaacatgcagtactgatattataattctcattttactttcattatttctaataagagattatgtgacttctttttcttttagttctattctacattcttaatattgtatattacctgaataattcaatttttttctaattgaatttcctattagttgactaaaagaagtgtcatgtttactcatatatgtagaacatgactgcctatcagtagattgatctgtatttaatattcgttaattaaatctgcagttttatttttgaaggaagccataactatttaatttccaaataattgcttcataaagaatcccatactctcagtttgcacaaaagaacaaaaaatatatatgtctctttaaatttaaatcttcatttagatggtaattacatatccttatatttactttaaaaaatcggcttatttgtttattttataaaaaatttagcaaagaaatattaatatagtgctgcatagtttggccaagcatactcatcatttctttgttcagctccacatttcctgtgaaactaacatcttattgagatttgaaactggtggtagtttcccaggaaggcacaggtggagttatttgtgagaagcaaagtgtttactaatgacaaagtagtaaaccattttcaagatgaaaactgatttctatttattttgcttcaaaggtcctgaaaaaataagcaattatcataacaatttgttattgatactggaggtttcattgacatgtctctcaaattaaagctcacactgcctccataaaagtcttcaacatctaatttataagctttacaagtatttattttataaggcttagacagaattattggagttttaaattaagtgtattggaaaagaaaggatggtatgtgtatgaaatgttaagatcctacgcaacactgctatttttttcctttaatatttgtgctgcataacaaaagccactagactgttactgtcttgtctgtccatgtgttaacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttacgctttatgatgatatagtttttcaaaattatttatagcttcatatgatgttttgtaattttttctattgatacctgttttaaaaatattttccaaggaagttgattaaaattatatttgttaccttttagaaaaagcattgaaatgagtttctcttgctttttcattttccctctgctttatatgctcttcgcaatacatcatgtccaacgggatacctattgttctcatgacacccaaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaagctgggattcttttgaagcagttgtaattaaacacatttataagaata

SEQ ID NO: 129239 - DNA, 4244 bp, Homo sapiens
  Payload ID: 5284
  Gene Symbol: EDIL3
  Gene Name: EGF-like repeats and discoidin I-like domains 3
  Uniprot ID: O43854
  ENST ID: ENST00000380138
  CDS Start-End: 13-1425
ggagacgggatcatgaagcgctcggtagccgtctggctcttggtcgggctcagcctcggtgtcccccagttcggcaaaggtgatatttgtgatcccaatccatgtgaaaatggaggtatctgtttgccaggattggctgatggttccttttcctgtgagtgtccagatggcttcacagaccccaactgttctagtgttgtggaggttggtccctgcactcctaatccatgccataatggaggaacctgtgaaataagtgaagcataccgaggggatacattcataggctatgtttgtaaatgtccccgaggatttaatgggattcactgtcagcacaacataaatgaatgcgaagttgagccttgcaaaaatggtggaatatgtacagatcttgttgctaactattcctgtgagtgcccaggcgaatttatgggaagaaattgtcaatacaaatgctcaggcccactgggaattgaaggtggaattatatcaaaccagcaaatcacagcttcctctactcaccgagctctttttggactccaaaaatggtatccctactatgcacgtcttaataagaaggggcttataaatgcgtggacagctgcagaaaatgacagatggccgtggattcagataaatttgcaaaggaaaatgagagttactggtgtgattacccaaggagccaagaggattggaagcccagagtatataaaatcctacaaaattgcctacagtaatgatggaaagacttgggcaatgtacaaagtgaaaggcaccaatgaagacatggtgtttcgtggaaacattgataacaacactccatatgctaactctttcacaccccccataaaagctcagtatgtaagactctatccccaagtttgtcgaagacattgcactttgcgaatggaacttcttggctgtgaactgtcgggttgttctgagcctctgggtatgaaatcaggacatatacaagactatcagatcactgcctccagcatcttcagaacgctcaacatggacatgttcacttgggaaccaaggaaagctcggctggacaagcaaggcaaagtgaatgcctggacctctggccacaatgaccagtcacaatggttacaggtggatcttcttgttccaaccaaagtgactggcatcattacacaaggagctaaagattttggtcatgtacagtttgttggctcctacaaactggcttacagcaatgatggagaacactggactgtataccaggatgaaaagcaaagaaaagataaggttttccagggaaattttgacaatgacactcacagaaaaaatgtcatcgaccctcccatctatgcacgacacataagaatccttccttggtcctggtacgggaggatcacattgcggtcagagctgctgggctgcacagaggaggaatgaggggaggctacatttcacaaccctcttccctatttccctaaaagtatctccatggaatgaactgtgcaaaatctgtaggaaactgaatggtttttttttttttttcatgaaaaagtgctcaaattatggtaggcaactaacggtgtttttaagggggtctaagcctgccttttcaatgatttaatttgattttattttatccgtcaaatctcttaagtaacaacacattaagtgtgaattacttttctctcattgtttcctgaattattcgcattggtagaaatatattagggaaagaaagtagccttctttttatagcaagagtaaaaaagtctcaaagtcatcaaataagagcaagagttgatagagcttttacaatcaatactcacctaattctgataaaaggaatactgcaatgttagcaataagtttttttcttctgtaatgactctacgttatcctgtttccctgtgcctaccaaacactgtcaatgtttattacaaaattttaaagaagaatatgtaacatgcagtactgatattataattctcattttactttcattatttctaataagagattatgtgacttctttttcttttagttctattctacattcttaatattgtatattacctgaataattcaatttttttctaattgaatttcctattagttgactaaaagaagtgtcatgtttactcatatatgtagaacatgactgcctatcagtagattgatctgtatttaatattcgttaattaaatctgcagttttatttttgaaggaagccataactatttaatttccaaataattgcttcataaagaatcccatactctcagtttgcacaaaagaacaaaaaatatatatgtctctttaaatttaaatcttcatttagatggtaattacatatccttatatttactttaaaaaatcggcttatttgtttattttataaaaaatttagcaaagaaatattaatatagtgctgcatagtttggccaagcatactcatcatttctttgttcagctccacatttcctgtgaaactaacatcttattgagatttgaaactggtggtagtttcccaggaaggcacaggtggagttatttgtgagaagcaaagtgtttactaatgacaaagtagtaaaccattttcaagatgaaaactgatttctatttattttgcttcaaaggtcctgaaaaaataagcaattatcataacaatttgttattgatactggaggtttcattgacatgtctctcaaattaaagctcacactgcctccataaaagtcttcaacatctaatttataagctttacaagtatttattttataaggcttagacagaattattggagttttaaattaagtgtattggaaaagaaaggatggtatgtgtatgaaatgttaagatcctacgcaacactgctatttttttcctttaatatttgtgctgcataacaaaagccactagactgttactgtcttgtctgtccatgtgttaacagcatttcttaatgatgtatatatggagtggtcttcaatcatagtgaagaatttaaagagaaagtcaattgtattggcatttttaataagaacaaaattagttcgtctaaggggactggctggccacatatttgttccttgcccatatgctttctacttcttgttcttattatgaaattatgaatttgaagcctctgaaatggtgatcagttttcaacatctttcaaaaacaaaattactatttcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttacgctttatgatgatatagtttttcaaaattatttatagcttcatatgatgttttgtaattttttctattgatacctgttttaaaaatattttccaaggaagttgattaaaattatatttgttaccttttagaaaaagcattgaaatgagtttctcttgctttttcattttccctctgctttatatgctcttcgcaatacatcatgtccaacgggatacctattgttctcatgacacccaaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattgtatctttgctagtcaacaacttatgaaatatactcaatgcgtctgatgtgtcattaagtgcagaaataactaagacacaaataacctttgcaaaccttcaagctgtgtaatattccaatgttgtttttttctttgtatatatacttatatcacgtaggatgtaaaaccagtatgaccttgtctagtctccaaacttaaaataaacttttgaaaagc

SEQ ID NO: 129240 - DNA, 4411 bp, Homo sapiens
  Payload ID: 5285
  Gene Symbol: EGFLAM
  Gene Name: EGF-like, fibronectin type III and laminin G domains
  Uniprot ID: Q63HQ2
  ENST ID: ENST00000322350
  CDS Start-End: 347-3376
agggcctgtccctctcacttccactcgattgtaatttcatccccgggccggtcgagcctccctccctcccgcggccagcccttccctcccagtcggcctccttcgtcgcccccgcccccgcgaaaagccctgcagcttgcagccggcttcactcgcgcacgccgacctcccggctgcagtcctacctcttggaactacccgtgtttccgggcccagccctcgcagccccccacctcctcgccccggcccggggatccgttggggccgcgtcccccacgcgcccccggagacgccctttccgtgtgcgcccgggacttggtgaaactttgcaggcgccggctgcgaaatggatttaatccgaggcgtcttgctccggctcctgctcctggcttccagcctcggacccggcgcggtgtcgctccgagcggccatccgaaaaccaggcaaggtagggcctcctcttgacatcaagctgggcgcattgaactgtacggctttcagcatccagtggaaaatgccaaggcatcctggaagtcccatccttgggtacactgtcttttactctgaggttggcgcagataaatccctgcaggagcagttgcacagcgtgcctctcagccgggacatcccgaccacggaggaagtgattggagatttgaaaccaggcactgaatatcgtgtgagcatagcagcttacagccaggctggcaaagggcggctgagctctcctcggcatgtcaccactttgtcccaagattcctgcctgcctcctgcagctccccagcagccacatgtcattgtggtttcggattctgaggtggccctgtcttggaaacctggagcgagtgaaggaagcgcccctattcagtactattctgtggaattcatcaggccagatttcgacaagaagtggacctcaatccatgagcggatccagatggactccatggttatcaagggcctcgatccagataccaactaccagtttgccgtgagggcaatgaattcccatggccccagcccccgcagctggcccagtgacatcatccggaccctctgccctgaggaggcgggaagtggccgctatggaccccgttatatcaccgacatgggagctggtgaggatgatgaaggatttgaagacgacttagatttggatatttcctttgaggaggttaaaccacttcctgctaccaaaggagggaataagaaatttttggtggaaagcaagaagatgtctatatctaacccaaagaccatttctaggctcatcccccctacctcagcatctctccctgtgaccacggtggctccccagcccattcccatacagagaaaggggaagaatggtgtggccataatgtcaaggctctttgacatgccttgtgatgaaactctctgctctgctgacagcttctgtgtcaatgactacacctgggggggctcgcgatgccagtgcaccctgggcaaaggtggtgagagctgctcagaagatattgttatccagtatcctcagttctttggccactcctatgtaacgtttgaacctctgaagaattcttatcaggcatttcaaattactcttgaatttagggcggaggcagaggatggcttactgctctactgtggggagaacgaacacgggaggggggatttcatgtccctggctatcatccgacgctccctgcagttcaggtttaattgtggaactggggttgccatcatcgtaagtgagaccaaaatcaaactagggggttggcacacggttatgctctacagagatgggctgaacgggctgctgcagctgaacaatggcaccccagtgacaggccagtctcagggccaatacagtaaaattactttccggacacctctctatcttggtggcgctcccagcgcttactggttggttagagcaacagggacaaaccgaggctttcaaggctgtgtgcagtcgctcgctgtgaatgggaggagaattgacatgaggccctggcccctgggaaaagcactcagtggggctgatgtgggggaatgcagcagtggaatctgtgatgaggcctcgtgcatccatggtggcacctgcacagcaatcaaagccgactcctacatttgcctctgtccccttgggtttaaaggtcgacactgtgaagatgctttcaccttgaccattcctcagttcagagagtctctgagatcttacgctgcaactccctggccactggagccccagcattacctttccttcatggaatttgagatcacatttcggccagactcaggagatggtgtcctcctgtacagctatgacacaggcagcaaagacttcctgtccatcaacttggcagggggccacgtggagttccgctttgactgtggctctgggaccggtgtcctcaggagtgaagatcccctcaccctgggcaactggcacgagcttcgtgtatctcgcacagcaaagaatggaatcttacaggtggataagcagaagatagtggagggaatggcagagggaggcttcacacagattaagtgcaacacagacattttcattggcggagtccccaattatgatgatgtgaagaagaactcgggtgtcctgaagcctttcagcgggagcatccagaagatcatcctgaatgaccgaaccatccatgtgaagcatgacttcacctccggagtgaatgtggagaatgcggcccacccctgtgtgagagccccttgtgcccatgggggcagctgccggcccaggaaggagggctatgactgtgactgccccttgggctttgaggggcttcactgccagaaagcgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccctgcctgatgctatatgcagaggcccagggaccaggtgtgtttcctctcaccaagaagaaagtacacactgatgagaaactgagaaccaagacaggcatccctgggtggcctttcctgctgacactccacgagctgacccagcagaattctctgtgtaggaagcatcggactttgtccattgaatatgtagcggctgccagagatcacacatcaatgcaaattccagagcctgtctgctatagctcagtgactgtgttgtgattcatagtacattaaaaagagagagagagagaaagaatcccacagggcactattaaaatacttctctccttccctgactcatgacactcttcctgacagcagaatgactgtgtgaccttgaacttcacatttcccacattggcccttggattgttcggattaaccccttccactcctcactggctggttcactgtgttctgactagtccataaaaataaagatggaaggagatcaaacacagaatcataatcataatgcggcccccttccccagagcttacctcgaatgtgaaatccctacttcttataatgcagagttaaggagctgagcccccatgattttgtagctgtacttttgtatgtgtatatttttatagctgcagattgtccacacagtatacttttggaagtttgggtggatgactctgaattcttgcacacctttcctaaaaatttctcccaagagagacttgtttgggccttttgtggtgtcagtggaatggataggtaacttgggtgggcaacttggggagctgaccattctcttttggtaaatgttgacggctcaagaggatgaatatgaagctttccaagataagcagattaaaaggaacatgtgttaccgaggtaggtcactgtcatttttgttttaagagttggggggagtatctatagtaaacttgaataaaggggacaaagctagaactta

SEQ ID NO: 129241 - DNA, 3071 bp, Homo sapiens
  Payload ID: 5285
  Gene Symbol: EGFLAM
  Gene Name: EGF-like, fibronectin type III and laminin G domains
  Uniprot ID: Q63HQ2
  ENST ID: ENST00000336740
  CDS Start-End: 342-2669
gacaactgagacggctgcagaccatggggcagggagcatatggagcacggatatgccagacagagggatgattcatatcccaggcaggatggagcagggcagtgtgctatttcatcgtgctactcagaacttatgaattgtttatttctggaatttcccatttaatatttttggactgtggttgatcgagggtaaatgaaattgcagaaagcaaaaatacagataagggggactgcttgctgtacaaagatagagacaagaggaaggagctgtcctcaagggccttttgtgtgaagacatctggcacacagatacgctgcatgcaggtggcttgagagaacatgcatccaggccctgaggaggcgggaagtggccgctatggaccccgttatatcaccgacatgggagctggtgaggatgatgaaggatttgaagacgacttagatttggatatttcctttgaggaggttaaaccacttcctgctaccaaaggagggaataagaaatttttggtggaaagcaagaagatgtctatatctaacccaaagaccatttctaggctcatcccccctacctcagcatctctccctgtgaccacggtggctccccagcccattcccatacagagaaaggggaagaatggtgtggccataatgtcaaggctctttgacatgccttgtgatgaaactctctgctctgctgacagcttctgtgtcaatgactacacctgggggggctcgcgatgccagtgcaccctgggcaaaggtggtgagagctgctcagaagatattgttatccagtatcctcagttctttggccactcctatgtaacgtttgaacctctgaagaattcttatcaggcatttcaaattactcttgaatttagggcggaggcagaggatggcttactgctctactgtggggagaacgaacacgggaggggggatttcatgtccctggctatcatccgacgctccctgcagttcaggtttaattgtggaactggggttgccatcatcgtaagtgagaccaaaatcaaactagggggttggcacacggttatgctctacagagatgggctgaacgggctgctgcagctgaacaatggcaccccagtgacaggccagtctcagggccaatacagtaaaattactttccggacacctctctatcttggtggcgctcccagcgcttactggttggttagagcaacagggacaaaccgaggctttcaaggctgtgtgcagtcgctcgctgtgaatgggaggagaattgacatgaggccctggcccctgggaaaagcactcagtggggctgatgtgggggaatgcagcagtggaatctgtgatgaggcctcgtgcatccatggtggcacctgcacagcaatcaaagccgactcctacatttgcctctgtccccttgggtttaaaggtcgacactgtgaagatgctttcaccttgaccattcctcagttcagagagtctctgagatcttacgctgcaactccctggccactggagccccagcattacctttccttcatggaatttgagatcacatttcggccagactcaggagatggtgtcctcctgtacagctatgacacaggcagcaaagacttcctgtccatcaacttggcagggggccacgtggagttccgctttgactgtggctctgggaccggtgtcctcaggagtgaagatcccctcaccctgggcaactggcacgagcttcgtgtatctcgcacagcaaagaatggaatcttacaggtggataagcagaagatagtggagggaatggcagagggaggcttcacacagattaagtgcaacacagacattttcattggcggagtccccaattatgatgatgtgaagaagaactcgggtgtcctgaagcctttcagcgggagcatccagaagatcatcctgaatgaccgaaccatccatgtgaagcatgacttcacctccggagtgaatgtggagaatgcggcccacccctgtgtgagagccccttgtgcccatgggggcagctgccggcccaggaaggagggctatgactgtgactgccccttgggctttgaggggcttcactgccagaaagcgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccctgcctgatgctatatgcagaggcccagggaccaggtgtgtttcctctcaccaagaagaaagtacacactgatgagaaactgagaaccaagacaggcatccctgggtggcctttcctgctgacactccacgagctgacccagcagaattctctgtgtaggaagcatcggactttgtccattgaatatgtagcggctgccagagatcacacatcaatgcaaattccagagcctgtctgctatagctcagtgactgtgttgtgattcatagtacattaaaaagagagagagagagaaagaatcccacagggcactattaaaatacttctctccttccctg

SEQ ID NO: 129242 - DNA, 3963 bp, Homo sapiens
  Payload ID: 5285
  Gene Symbol: EGFLAM
  Gene Name: EGF-like, fibronectin type III and laminin G domains
  Uniprot ID: Q63HQ2
  ENST ID: ENST00000354891
  CDS Start-End: 347-3400
agggcctgtccctctcacttccactcgattgtaatttcatccccgggccggtcgagcctccctccctcccgcggccagcccttccctcccagtcggcctccttcgtcgcccccgcccccgcgaaaagccctgcagcttgcagccggcttcactcgcgcacgccgacctcccggctgcagtcctacctcttggaactacccgtgtttccgggcccagccctcgcagccccccacctcctcgccccggcccggggatccgttggggccgcgtcccccacgcgcccccggagacgccctttccgtgtgcgcccgggacttggtgaaactttgcaggcgccggctgcgaaatggatttaatccgaggcgtcttgctccggctcctgctcctggcttccagcctcggacccggcgcggtgtcgctccgagcggccatccgaaaaccaggcaaggtagggcctcctcttgacatcaagctgggcgcattgaactgtacggctttcagcatccagtggaaaatgccaaggcatcctggaagtcccatccttgggtacactgtcttttactctgaggttggcgcagataaatccctgcaggagcagttgcacagcgtgcctctcagccgggacatcccgaccacggaggaagtgattggagatttgaaaccaggcactgaatatcgtgtgagcatagcagcttacagccaggctggcaaagggcggctgagctctcctcggcatgtcaccactttgtcccaagattcctgcctgcctcctgcagctccccagcagccacatgtcattgtggtttcggattctgaggtggccctgtcttggaaacctggagcgagtgaaggaagcgcccctattcagtactattctgtggaattcatcaggccagatttcgacaagaagtggacctcaatccatgagcggatccagatggactccatggttatcaagggcctcgatccagataccaactaccagtttgccgtgagggcaatgaattcccatggccccagcccccgcagctggcccagtgacatcatccggaccctctgccctgaggaggcgggaagtggccgctatggaccccgttatatcaccgacatgggagctggtgaggatgatgaaggatttgaagacgacttagatttggatatttcctttgaggaggttaaaccacttcctgctaccaaaggagggaataagaaatttttggtggaaagcaagaagatgtctatatctaacccaaagaccatttctaggctcatcccccctacctcagcatctctccctgtgaccacggtggctccccagcccattcccatacagagaaaggggaagaatggtgtggccataatgtcaaggctctttgacatgccttgtgatgaaactctctgctctgctgacagcttctgtgtcaatgactacacctgggggggctcgcgatgccagtgcaccctgggcaaaggtggtgagagctgctcagaagatattgttatccagtatcctcagttctttggccactcctatgtaacgtttgaacctctgaagaattcttatcaggcatttcaaattactcttgaatttagggcggaggcagaggatggcttactgctctactgtggggagaacgaacacgggaggggggatttcatgtccctggctatcatccgacgctccctgcagttcaggtttaattgtggaactggggttgccatcatcgtaagtgagaccaaaatcaaactagggggttggcacacggttatgctctacagagatgggctgaacgggctgctgcagctgaacaatggcaccccagtgacaggccagtctcagggccaatacagtaaaattactttccggacacctctctatcttggtggcgctcccagcgcttactggttggttagagcaacagggacaaaccgaggctttcaaggctgtgtgcagtcgctcgctgtgaatgggaggagaattgacatgaggccctggcccctgggaaaagcactcagtggggctgatgtgggggaatgcagcagtggaatctgtgatgaggcctcgtgcatccatggtggcacctgcacagcaatcaaagccgactcctacatttgcctctgtccccttgggtttaaaggtcgacactgtgaagatgctttcaccttgaccattcctcagttcagagagtctctgagatcttacgctgcaactccctggccactggagccccagcattacctttccttcatggaatttgagatcacatttcggccagactcaggagatggtgtcctcctgtacagctatgacacaggcagcaaagacttcctgtccatcaacttggcagggggccacgtggagttccgctttgactgtggctctgggaccggtgtcctcaggagtgaagatcccctcaccctgggcaactggcacgagcttcgtgtatctcgcacagcaaagaatggaatcttacaggtggataagcagaagatagtggagggaatggcagagggaggcttcacacagattaagtgcaacacagacattttcattggcggagtccccaattatgatgatgtgaagaagaactcgggtgtcctgaagcctttcagcgggagcatccagaagatcatcctgaatgaccgaaccatccatgtgaagcatgacttcacctccggagtgaatgtggagaatgcggcccacccctgtgtgagagccccttgtgcccatgggggcagctgccggcccaggaaggagggctatgactgtgactgccccttgggctttgaggggcttcactgccagaaagagtgtgggaactactgcctcaatacgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccctgcctgatgctatatgcagaggcccagggaccaggtgtgtttcctctcaccaagaagaaagtacacactgatgagaaactgagaaccaagacaggcatccctgggtggcctttcctgctgacactccacgagctgacccagcagaattctctgtgtaggaagcatcggactttgtccattgaatatgtagcggctgccagagatcacacatcaatgcaaattccagagcctgtctgctatagctcagtgactgtgttgtgattcatagtacattaaaaagagagagagagagaaagaatcccacagggcactattaaaatacttctctccttccctgactcatgacactcttcctgacagcagaatgactgtgtgaccttgaacttcacatttcccacattggcccttggattgttcggattaaccccttccactcctcactggctggttcactgtgttctgactagtccataaaaataaagatggaaggagatcaaa

SEQ ID NO: 129243 - DNA, 2398 bp, Homo sapiens
  Payload ID: 5285
  Gene Symbol: EGFLAM
  Gene Name: EGF-like, fibronectin type III and laminin G domains
  Uniprot ID: Q63HQ2
  ENST ID: ENST00000397202
  CDS Start-End: 708-1835
gagacggctgcagaccatggggcagggagcatatggagcacggatatgccagacagagggatgattcatatcccaggcaggatggagcagggcagtgtgctatttcatcgtgctactcagaacttatgaattgtttatttctggaatttcccatttaatatttttggactgtggttgatcgagggtaaatgaaattgcagaaagcaaaaatacagataagggggactgcttgctgtacaaagatagagacaagaggaaggagctgtcctcaagggccttttgtgtgaagacatctggcacacagatacgctgcatgcaggtggcttgagagaacatgcatccaggtttaattgtggaactggggttgccatcatcgtaagtgagaccaaaatcaaactagggggttggcacacggttatgctctacagagatgggctgaacgggctgctgcagctgaacaatggcaccccagtgacaggccagtctcaggggaatgcagcagtggaatctgtgatgaggcctcgtgcatccatggtggcacctgcacagcaatcaaagccgactcctacatttgcctctgtccccttgggtttaaaggtcgacactgtgaagatgctttcaccttgaccattcctcagttcagagagtctctgagatcttacgctgcaactccctggccactggagccccagcattacctttccttcatggaatttgagatcacatttcggccagactcaggagatggtgtcctcctgtacagctatgacacaggcagcaaagacttcctgtccatcaacttggcagggggccacgtggagttccgctttgactgtggctctgggaccggtgtcctcaggagtgaagatcccctcaccctgggcaactggcacgagcttcgtgtatctcgcacagcaaagaatggaatcttacaggtggataagcagaagatagtggagggaatggcagagggaggcttcacacagattaagtgcaacacagacattttcattggcggagtccccaattatgatgatgtgaagaagaactcgggtgtcctgaagcctttcagcgggagcatccagaagatcatcctgaatgaccgaaccatccatgtgaagcatgacttcacctccggagtgaatgtggagaatgcggcccacccctgtgtgagagccccttgtgcccatgggggcagctgccggcccaggaaggagggctatgactgtgactgccccttgggctttgaggggcttcactgccagaaagcgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccctgcctgatgctatatgcagaggcccagggaccaggtgtgtttcctctcaccaagaagaaagtacacactgatgagaaactgagaaccaagacaggcatccctgggtggcctttcctgctgacactccacgagctgacccagcagaattctctgtgtaggaagcatcggactttgtccattgaatatgtagcggctgccagagatcacacatcaatgcaaattccagagcctgtctgctatagctcagtgactgtgttgtgattcatagtacattaaaaagagagagagagagaaagaatcccacagggcactattaaaatacttctctccttccctgactcatgacactcttcctgacagcagaatgactgtgtgaccttgaacttcacatttcccacattggcccttggattgttcggattaaccccttccactcctcactggctggttcactgtgttctgactagtccataaaaataaagatggaaggagatcaaa

SEQ ID NO: 129244 - DNA, 1299 bp, Homo sapiens
  Payload ID: 5285
  Gene Symbol: EGFLAM
  Gene Name: EGF-like, fibronectin type III and laminin G domains
  Uniprot ID: Q63HQ2
  ENST ID: ENST00000397210
  CDS Start-End: 271-729
gacgttctggactctcgggcagagctttgtgagagaaacaaggctggcttcaagtgatctgcaaccagagtaattgggatttgacaaggactgtgaaaggctgactctccctgttctctttcatgctggcaccgggcagagtgtgggaactactgcctcaatacgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccctgcctgatgctatatgcagaggcccagggaccaggtgtgtttcctctcaccaagaagaaagtacacactgatgagaaactgagaaccaagacaggcatccctgggtggcctttcctgctgacactccacgagctgacccagcagaattctctgtgtaggaagcatcggactttgtccattgaatatgtagcggctgccagagatcacacatcaatgcaaattccagagcctgtctgctatagctcagtgactgtgttgtgattcatagtacattaaaaagagagagagagagaaagaatcccacagggcactattaaaatacttctctccttccctgactcatgacactcttcctgacagcagaatgactgtgtgaccttgaacttcacatttcccacattggcccttggattgttcggattaaccccttccactcctcactggctggttcactgtgttctgactagtccataaaaataaagatggaaggagatcaaacacagaa

SEQ ID NO: 129245 - DNA, 676 bp, Homo sapiens
  Payload ID: 5285
  Gene Symbol: EGFLAM
  Gene Name: EGF-like, fibronectin type III and laminin G domains
  Uniprot ID: Q63HQ2
  ENST ID: ENST00000514476
  CDS Start-End: 153-611
agagaaccacatactatgtaacctcctttttctgttctgtcccagcgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccc

SEQ ID NO: 129246 - DNA, 889 bp, Homo sapiens
  Payload ID: 5285
  Gene Symbol: EGFLAM
  Gene Name: EGF-like, fibronectin type III and laminin G domains
  Uniprot ID: Q63HQ2
  ENST ID: ENST00000506135
  CDS Start-End: 280-738
agagaaacaaggctggcttcaagtgatctgcaaccagagtaattgggatttgacaaggactgtgaaaggctgactctccctgttctctttcatgctggcaccgggcagagtgtgggaactactgcctcaatacgatcatagaagccattgagatcccgcagtttatcggccgcagttacctgacgtatgacaacccagatatcttgaagaggtaataagcttcaacaggcaccttcctcagctttctggggggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccctgcctgatgctatatgcagaggcccagggaccaggtgtgtttcctctcaccaagaagaaagtacacactgatgagaaactgagaac

SEQ ID NO: 129247 - DNA, 821 bp, Homo sapiens
  Payload ID: 5285
  Gene Symbol: EGFLAM
  Gene Name: EGF-like, fibronectin type III and laminin G domains
  ENST ID: ENST00000504709
  CDS Start-End: 91-234
cgttggggccgcgtcccccacgcgcccccggagacgccctttccgtgtgcgcccgggacttggtgaaactttgcaggcgccggctgcgaaatggatttaatccgaggcgtcttgctccggctcctgctcctggcttccagcctcggacccggcgcggtgtcgctccgagcggccatccgaaaaccaggaaggtgttggaggatgactgtcacgaaaacttggacagaaccatgacgcaggaccaaagctgcaggaaacagaagatccaatccaggagagggatataagaagtccccagaataatagtgggaaggagatgctagaatgacaaatatttactagatagaaaaggcaaccagtccaactggaacaggcaaggtagggcctcctcttgacatcaagctgggcgcattgaactgtacggctttcagcatccagtggaaaatgccaaggcatcctggaagtcccatccttgggtacactgtcttttactctgaggttggcgcagataaatccctgcaggagcagttgcacagcgtgcctctcagccgggacatcccgaccacggaggaagtgattggagatttgaaaccaggcactgaatatcgtgtgagcatagcagcttacagccaggctggcaaagggcggctgagctctcctcggcatgtcaccactttgtcccaagattcctgcctgcctcctgcagctccccagcagccacatgtcattgtggtttcggattctgaggtggccctgtcttggaaacctggagcgagtgaaggaagcgcccctattcagtactattctgtggaattcatcag

SEQ ID NO: 129248 - DNA, 552 bp, Homo sapiens
  Payload ID: 5285
  Gene Symbol: EGFLAM
  Gene Name: EGF-like, fibronectin type III and laminin G domains
  ENST ID: ENST00000508131
  CDS Start-End: 215-552
atctgcaaccagagtaattgggatttgacaaggactgtgaaaggctgactctccctgttctctttcatgctggcaccgggcagagtgtgggaactactgcctcaatagtaagtacaaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacag

SEQ ID NO: 129249 - DNA, 2398 bp, Homo sapiens
  Payload ID: 5286
  Gene Symbol: EGFL6
  Gene Name: EGF-like-domain, multiple 6
  Uniprot ID: Q8IUX8
  ENST ID: ENST00000361306
  CDS Start-End: 258-1919
accccgtccagcttcatccgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagcaagggagtctgtgaagctacatgcgaacctggatgtaagtttggtgagtgcgtgggaccaaacaaatgcagatgctttccaggatacaccgggaaaacctgcagtcaagatgtgaatgagtgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggtttcgaactgcaatatatcagtggacgatatgactgtatagatataaatgaatgtactatggatagccatacgtgcagccaccatgccaattgcttcaatacccaagggtccttcaagtgtaaatgcaagcagggatataaaggcaatggacttcggtgttctgctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagatttaaatatctcggttgactgcagcttcaatcatgggatctgtgactggaaacaggatagagaagatgattttgactggaatcctgctgatcgagataatgctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatc

SEQ ID NO: 129250 - DNA, 2385 bp, Homo sapiens
  Payload ID: 5286
  Gene Symbol: EGFL6
  Gene Name: EGF-like-domain, multiple 6
  Uniprot ID: Q8IUX8
  ENST ID: ENST00000380602
  CDS Start-End: 241-1905
ccgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagcaagggagtctgtgaagctacatgcgaacctggatgtaagtttggtgagtgcgtgggaccaaacaaatgcagatgctttccaggatacaccgggaaaacctgcagtcaagatgtgaatgagtgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggtttcgaactgcaatatatcagtggacgatatgactgtatagatataaatgaatgtactatggatagccatacgtgcagccaccatgccaattgcttcaatacccaagggtccttcaagtgtaaatgcaagcagggatataaaggcaatggacttcggtgttctgctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagcagatttaaatatctcggttgactgcagcttcaatcatgggatctgtgactggaaacaggatagagaagatgattttgactggaatcctgctgatcgagataatgctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatca

SEQ ID NO: 129251 - DNA, 1747 bp, Homo sapiens
  Payload ID: 5287
  Gene Symbol: EGFL7
  Gene Name: EGF-like-domain, multiple 7
  Uniprot ID: Q9UHF1
  ENST ID: ENST00000308874
  CDS Start-End: 535-1356
gcaccaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagagcagcccctgtggttggcagcaaagttcagcttggctgggcccgctgtgaggggcttcgcgctacgccctgcggtgtcccgagggctgaggtctcctcatcttctccctagcagtggatgagcaacccaacgggggcccggggaggggaactggccccgagggagaggaaccccaaagccacatctgtagccaggatgagcagtgtgaatccaggcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaaaccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtg

SEQ ID NO: 129252 - DNA, 1282 bp, Homo sapiens
  Payload ID: 5287
  Gene Symbol: EGFL7
  Gene Name: EGF-like-domain, multiple 7
  Uniprot ID: Q9UHF1
  ENST ID: ENST00000371698
  CDS Start-End: 69-890
ggcgcgtgcgcgccccggatccggcggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaaaccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtga

SEQ ID NO: 129253 - DNA, 2125 bp, Homo sapiens
  Payload ID: 5287
  Gene Symbol: EGFL7
  Gene Name: EGF-like-domain, multiple 7
  Uniprot ID: Q9UHF1
  ENST ID: ENST00000371699
  CDS Start-End: 912-1733
agatgcaaagccggtggggacctgccaagaagccagcccacaaggccatggactcctccacgccatcagctggagcagtgggcagccccaggaagggagacgggagcggccaggggaagggcgaggggtcccccgggcgacccccgaggctcaggcgcccggactccagtcctgggcctccgttttccacccttgaacaagcggcttccacctgtgagccagctgcctcctctgaaaatggaagcccctcaactcagagggtgtcgctctgggacgtgggtcaggggccggagcaggcagggagaggtgagaggaaaggctggggaccctcacttctccctgcccaaaccctcgctcgggagcagacggctcctctgcccgcaggcacccctgcctggcagctccctccagcccccgtcgggtccgggacgtcctctgatgggaaggttccaccacatccgtggctgacagagccagcccgtccgaggccggggggcgctcggggtaaacaggaagccccatccctcccgcactctgcttcactccctcctcctgcacctcctgcagcccggctcccgcggccgcgcctggtgcccctctgtctcgcgccacctgagatgcccaggctggcctctgccaggggcttagtctgccctctcctggggcttcagaggccaaaagcaccctggtgaggggtccgggaggcccgggagggcccggggggctctgccaggcccctccacgcctctctgcccagccagcacgctctgggaagcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaaaccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtga

SEQ ID NO: 129254 - DNA, 1529 bp, Homo sapiens
  Payload ID: 5287
  Gene Symbol: EGFL7
  Gene Name: EGF-like-domain, multiple 7
  Uniprot ID: Q9UHF1
  ENST ID: ENST00000406555
  CDS Start-End: 316-1137
ccaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaaaccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtga

SEQ ID NO: 129255 - DNA, 723 bp, Homo sapiens
  Payload ID: 5287
  Gene Symbol: EGFL7
  Gene Name: EGF-like-domain, multiple 7
  ENST ID: ENST00000492862
  CDS Start-End: 527-723
aagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagagcagcccctgtggttggcagcaaagttcagcttggctgggcccgctgtgaggggcttcgcgctacgccctgcggtgtcccgagggctgaggtctcctcatcttctccctagcagtggatgagcaacccaacgggggcccggggaggggaactggccccgagggagaggaaccccaaagccacatctgtagccaggatgagcagtgtgaatccaggcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccg

SEQ ID NO: 129256 - DNA, 1310 bp, Homo sapiens
  Payload ID: 5288
  Gene Symbol: EGFL8
  Gene Name: EGF-like-domain, multiple 8
  Uniprot ID: Q99944
  ENST ID: ENST00000333845
  CDS Start-End: 104-985
ccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 129257 - DNA, 1312 bp, Homo sapiens
  Payload ID: 5288
  Gene Symbol: EGFL8
  Gene Name: EGF-like-domain, multiple 8
  Uniprot ID: Q99944
  ENST ID: ENST00000395512
  CDS Start-End: 106-987
gctgcttctgctgaggctggtctgcttgaagcctcccaggagaaagaagccaggtgggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 129258 - DNA, 1312 bp, Homo sapiens
  Payload ID: 5288
  Gene Symbol: EGFL8
  Gene Name: EGF-like-domain, multiple 8
  Uniprot ID: Q99944
  ENST ID: ENST00000399648
  CDS Start-End: 106-987
gctgcttctgctgaggctggtctgcttgaagcctcccaggagaaagaagccaggtgggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaagcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 129259 - DNA, 825 bp, Homo sapiens
  Payload ID: 5288
  Gene Symbol: EGFL8
  Gene Name: EGF-like-domain, multiple 8
  ENST ID: ENST00000454755
  CDS Start-End: 51-825
gggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtgggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcct

SEQ ID NO: 129260 - DNA, 1312 bp, Homo sapiens; identical to SEQ ID NO: 129257
  Payload ID: 5288
  Gene Symbol: EGFL8
  Gene Name: EGF-like-domain, multiple 8
  Uniprot ID: Q99944
  ENST ID: ENST00000433364
  CDS Start-End: 106-987

SEQ ID NO: 129261 - DNA, 1312 bp, Homo sapiens; identical to SEQ ID NO: 129257
  Payload ID: 5288
  Gene Symbol: EGFL8
  Gene Name: EGF-like-domain, multiple 8
  Uniprot ID: Q99944
  ENST ID: ENST00000413733
  CDS Start-End: 106-987

SEQ ID NO: 129262 - DNA, 1310 bp, Homo sapiens
  Payload ID: 5288
  Gene Symbol: EGFL8
  Gene Name: EGF-like-domain, multiple 8
  Uniprot ID: Q99944
  ENST ID: ENST00000443511
  CDS Start-End: 104-985
ccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaacggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 129263 - DNA, 825 bp, Homo sapiens; identical to SEQ ID NO: 129259
  Payload ID: 5288
  Gene Symbol: EGFL8
  Gene Name: EGF-like-domain, multiple 8
  ENST ID: ENST00000418522
  CDS Start-End: 51-825

SEQ ID NO: 129264 - DNA, 1310 bp, Homo sapiens; identical to SEQ ID NO: 129256
  Payload ID: 5288
  Gene Symbol: EGFL8
  Gene Name: EGF-like-domain, multiple 8
  Uniprot ID: Q99944
  ENST ID: ENST00000452189
  CDS Start-End: 104-985

SEQ ID NO: 129265 - DNA, 1277 bp, Homo sapiens
  Payload ID: 5288
  Gene Symbol: EGFL8
  Gene Name: EGF-like-domain, multiple 8
  Uniprot ID: Q99944
  ENST ID: ENST00000450526
  CDS Start-End: 74-955
tgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcaattccttaacaaatgcaaccaccaacacccagatctctctctctctttattttcagtttttttgctgttatccagataattaataaaaaccaaccacgcaaaa

SEQ ID NO: 129266 - DNA, 825 bp, Homo sapiens; identical to SEQ ID NO: 129259
  Payload ID: 5288
  Gene Symbol: EGFL8
  Gene Name: EGF-like-domain, multiple 8
  ENST ID: ENST00000432129
  CDS Start-End: 51-825

SEQ ID NO: 129267 - DNA, 825 bp, Homo sapiens
  Payload ID: 5288
  Gene Symbol: EGFL8
  Gene Name: EGF-like-domain, multiple 8
  ENST ID: ENST00000423079
  CDS Start-End: 51-825
gggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtgggcagcttcacctgcggctgcccccatgacctagtgctaggcgtggacgggcgcacctgcatggaggggtccccagagcccccaaccagtgccagcatactcagcgtggccgttcgggaggcagaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcct

SEQ ID NO: 129268 - DNA, 825 bp, Homo sapiens
  Payload ID: 5288
  Gene Symbol: EGFL8
  Gene Name: EGF-like-domain, multiple 8
  ENST ID: ENST00000422193
  CDS Start-End: 51-825
gggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaagcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtgggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcct

SEQ ID NO: 129269 - DNA, 825 bp, Homo sapiens; identical to SEQ ID NO: 129259
  Payload ID: 5288
  Gene Symbol: EGFL8
  Gene Name: EGF-like-domain, multiple 8
  ENST ID: ENST00000411747
  CDS Start-End: 51-825

SEQ ID NO: 129270 - DNA, 1309 bp, Homo sapiens
  Payload ID: 5288
  Gene Symbol: EGFL8
  Gene Name: EGF-like-domain, multiple 8
  Uniprot ID: Q99944
  ENST ID: ENST00000436155
  CDS Start-End: 106-987
gctgcttctgctgaggctggtctgcttgaagcctcccaggagaaagaagccaggtgggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcaattccttaacaaatgcaaccaccaacacccagatctctctctctctttattttcagtttttttgctgttatccagataattaataaaaaccaaccacgcaaaa

SEQ ID NO: 129271 - DNA, 1310 bp, Homo sapiens
  Payload ID: 5288
  Gene Symbol: EGFL8
  Gene Name: EGF-like-domain, multiple 8
  Uniprot ID: Q99944
  ENST ID: ENST00000447331
  CDS Start-End: 104-985
ccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaagcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 129272 - DNA, 1310 bp, Homo sapiens
  Payload ID: 5288
  Gene Symbol: EGFL8
  Gene Name: EGF-like-domain, multiple 8
  Uniprot ID: Q99944
  ENST ID: ENST00000455889
  CDS Start-End: 104-985
ccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcagaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 129273 - DNA, 825 bp, Homo sapiens; identical to SEQ ID NO: 129259
  Payload ID: 5288
  Gene Symbol: EGFL8
  Gene Name: EGF-like-domain, multiple 8
  ENST ID: ENST00000421005
  CDS Start-End: 51-825

SEQ ID NO: 129274 - DNA, 1312 bp, Homo sapiens
  Payload ID: 5288
  Gene Symbol: EGFL8
  Gene Name: EGF-like-domain, multiple 8
  Uniprot ID: Q99944
  ENST ID: ENST00000418252
  CDS Start-End: 106-987
gctgcttctgctgaggctggtctgcttgaagcctcccaggagaaagaagccaggtgggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaacggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 129275 - DNA, 1310 bp, Homo sapiens; identical to SEQ ID NO: 129256
  Payload ID: 5288
  Gene Symbol: EGFL8
  Gene Name: EGF-like-domain, multiple 8
  Uniprot ID: Q99944
  ENST ID: ENST00000414111
  CDS Start-End: 104-985

SEQ ID NO: 129276 - DNA, 1312 bp, Homo sapiens
  Payload ID: 5288
  Gene Symbol: EGFL8
  Gene Name: EGF-like-domain, multiple 8
  Uniprot ID: Q99944
  ENST ID: ENST00000452290
  CDS Start-End: 106-987
gctgcttctgctgaggctggtctgcttgaagcctcccaggagaaagaagccaggtgggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcagaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 129277 - DNA, 7097 bp, Homo sapiens
  Payload ID: 5289
  Gene Symbol: EGLN1
  Gene Name: egl-9 family hypoxia-inducible factor 1
  Uniprot ID: Q9GZT9
  ENST ID: ENST00000366641
  CDS Start-End: 3157-4437
ttaggggcagaaaaacatttgtaataattaatggctttgagagacacaaggctttgtttgccccagagtattagttaacccacctagtgctcctaatcatacaatattaaggattgggagggacattcattgcctcactctctatttgtttcaccttctgtaaaattggtagaataatagtacccacttcatagcattgtatgatgattaaattggttaatatttttaaaatgcttagaacacagattgggcacataacagcaagcaccacatgtgtttataagataaattcctttgtgttgccttccgttaaagtttaaataagtaaataaataaataaatacttgcatgacattttgaagtctctctataacatctgagtaagtggcggctgcgacaatgctactggagttccagaatcgtgttggtgacaagattgttcaccagcatatggtgtggtgaaaactcactaatttggaattagttcagattattaagcctgaataggtgaaaatcctgaaatcaaggatctttggaactatttgaaatcagtattttatattttcctgttgtattcattaaagtgttgcaagtgttctatttgatggattaagtatatttaggatatacatgttcaatttgtgattttgtatacttaattggaacaagaaagctaataaaggttttgatatggacatctattcttttaagtaaacttcaatgaaaatatatgagtagagcatatagagatgtaaataatttgtggacacaccacagactgaaatagcaaatttaaaagaaattgttggaagaatcaagtgtttgtggaatgagtcctcctagtaaagttcctgctcttgtgaataattaagcctcatgtataattactatagcaaaaggaagcctaagaagtattagactctacttgtatttaaattacattttacataatttatgtgtatgaaaaatgttttaaatgcttattttcgtaagccatgagatagctcctttatattttaagaatttctgaattaatttgcttggattttattagtgcaaatggcagagctagcaattcctttttctgtgttcccattccatcctattcatccctcttttaggaaactctgaactctggattgtccttgtttacatacctgcctcctgcattggactatgtgtctctgagtgtagtatgactaattcatttgtttgtcaaggactctcaatgcatttgttgaacagcctaattagtaatgtctgcaacaatgacattttactgtatttaataaagctctgggaaagtaggatacacataagacaggtctaggtctaaattctttacagaaacttggatttttagttcggtttgaaatttgaagatgtgagtatatttatctcagtttcccaaaggacaagctaattggaattatcatcctctttcacttgattggatccccagaatgccatttacgcatgcagcaggattttataacagttttaaattctgtatatttgatgaagaggttttatatttttggattcaagcctctttttaaacttctacaatatggtttacaataattccttatatcctgcttttgaaatacatattacaactttttaagtttggaaggctatatttcaaggactgaagttacagtatactcaagtgatacacaagcctagcaccccactttccacatagtgttcgataaagattgataaactcgaaatcacagaccttttaattcttaagacaaatagcagcagaaagaaacatctttggcttatttctggtaaggtttttatgctctgtaaaacaaagaattgtattcatccgcgcagcacagattctattaaaaataaatgtgagagtcgttaatgtagtactgctcatttaccatcaaaattcacttttcaggaataatcccatcagtttaaattggatattggaatgagcattgattacatttaacttggtagcccaaaatttcttcatggggttttgaactcggcgggatttcaaaggttttaaaaatgagtttttgattttttttaaaaccctcaaatttcattacctttaaactaggtcgaaacggggcgcaagagattggattaacaccatagtaatacttattttgttcttaaccatttcagggcttcttgaaatagaggctgtatggtgtaatggaaaaaacagccttggaatctgggagcctgattcctggattcagtcccagttttgcgtgaccttgggcaagttactttacttctctgaatttccgtttcctcctctgcaaaatgaggatcgcaatagccaccttgcaaccttgactggagcgagcctcgcacaccccgcgccggcctggaggaagagcagccatgattacgccgccttcgctccgctacccgcttgcggctggcgccctcctccagcaggtgtaggcgctgccgcgctgccccacgcctttccgccgctcgcgggcctgcgcctcggcgtccccgaggaggccgctgcgggctgaggtagcgcaccggcctctcggcgtcccagtccggtcccgggcggagggaaagcgggcgacccacctccgaggcagaagccgaggcccggccccgccgagtgcggaggagcgcaggcagcccccgcccctcggccctccccccggccctcccggccctccctccgccccctccgccctcgcgcgccgcccgcccgggtcgccgcggggccgtggtgtacgtgcagagcgcgcagagcgagtggcgcccgtatgccctgcgctcctccacagcctgggccgggccgcccgggacgctgaggcggcggcggcggccgagggggccggtcttgcgctccccaggcccgcgcgcctgagcccaggttgccattcgccgcacaggccctattctctcagccctcggcggcgatgaggcgctgaggcggctgccggcgctgcgccggagcttaggactcggaagcggccgggccgagggcgtggggtgccggcctccctgaggcgagggtagcgggtgcatggcgcagtaacggcccctatctctctccccgctccccagcctcgggcgaggccgtccggccgctacccctcctgctcggccgccgcagtcgccgtcgccgccgccgccgccgccatggccaatgacagcggcgggcccggcgggccgagcccgagcgagcgagaccggcagtactgcgagctgtgcgggaagatggagaacctgctgcgctgcagccgctgccgcagctccttctactgctgcaaggagcaccagcgtcaggactggaagaagcacaagctcgtgtgccagggcagcgagggcgccctcggccacggagtgggcccacaccagcattccggccccgcgccgccggctgcagtgccgccgcccagggccggggcccgggagcccaggaaggcagcggcgcgccgggacaacgcctccggggacgcggccaagggaaaagtaaaggccaagcccccggccgacccagcggcggccgcgtcgccgtgtcgtgcggccgccggcggccagggctcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatctgtgtggtggacgacttcctcggcaaggagaccggacagcagatcggcgacgaggtgcgcgccctgcacgacaccgggaagttcacggacgggcagctggtcagccagaagagtgactcgtccaaggacatccgaggcgataagatcacctggatcgagggcaaggagcccggctgcgaaaccattgggctgctcatgagcagcatggacgacctgatacgccactgtaacgggaagctgggcagctacaaaatcaatggccggacgaaagccatggttgcttgttatccgggcaatggaacgggttatgtacgtcatgttgataatccaaatggagatggaagatgtgtgacatgtatatattatcttaataaagactgggatgccaaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtacgcaataactgtttggtattttgatgcagatgagagagcacgagctaaagtaaaatatctaacaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgattgttgccagtgactgatgattaattttattttacttaaaataagaaaaggagcactttaattacaactgaaaaatcagattgttttgtagtccttccttacactaatttgaactgttaaagattgctgctttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgcctcccaggttcaagcaatcctcccacctcagcctcccaactagctgggactgcaggcacacaccaccatgcctgactaatttttgtatgtttagtagagacggggttttgccatgttgcctaggctggggtttaagttaaattttttaaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttgaaacatta

SEQ ID NO: 129278 - DNA, 2102 bp, Homo sapiens
  Payload ID: 5290
  Gene Symbol: EGLN2
  Gene Name: egl-9 family hypoxia-inducible factor 2
  Uniprot ID: Q96KS0
  ENST ID: ENST00000303961
  CDS Start-End: 311-1534
gggcggggtatggcgcgctgtgcggcgcagggcggctggcacaaacggcggcgccggggccggaggaaaaagctcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 129279 - DNA, 2150 bp, Homo sapiens
  Payload ID: 5290
  Gene Symbol: EGLN2
  Gene Name: egl-9 family hypoxia-inducible factor 2
  Uniprot ID: Q96KS0
  ENST ID: ENST00000406058
  CDS Start-End: 359-1582
gagcggcccttaggccctgcccctgtcgcctactgcgctcagaaggggcctcagggcctgccccgggttgggggcgttggggtgccctggatgggggcacctttatctctcgtcctgtctccggccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 129280 - DNA, 709 bp, Homo sapiens
  Payload ID: 5290
  Gene Symbol: EGLN2
  Gene Name: egl-9 family hypoxia-inducible factor 2
  ENST ID: ENST00000593525
  CDS Start-End: 479-709
cttccgtctgggcgtgtgtccgcccccggccggcttcctcccgtcgggctcgggtcgaccccaccgtcccgctccgccccgggtcctccctcccagcttccctccggtctatttttctgtctctgggcccctcgttctctttgtttttggactccccagtttcctctgtcttttgacccccccgcccccaccctgactctccctggaacccccacgtttctcgttgtctttctggaacgccgagccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgg

SEQ ID NO: 129281 - DNA, 584 bp, Homo sapiens
  Payload ID: 5290
  Gene Symbol: EGLN2
  Gene Name: egl-9 family hypoxia-inducible factor 2
  ENST ID: ENST00000601733
  CDS Start-End: 303-584
agtctcgggacctcccttccgtctgggcgtgtgtccgcccccggccggcttcctcccgtcgggctcggccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaa

SEQ ID NO: 129282 - DNA, 2821 bp, Homo sapiens
  Payload ID: 5290
  Gene Symbol: EGLN2
  Gene Name: egl-9 family hypoxia-inducible factor 2
  Uniprot ID: Q96KS0
  ENST ID: ENST00000593726
  CDS Start-End: 1029-2252
tactgcgctcagaaggggcctcagggcctgccccgggttgggggcgttggggtgccctggatgggggcacctttatctctcgtcctgtctccgggtgcgtgcaccctcctccgtcctttcctctgtcgccgcggaccctctccccgagggcccctcccgtcggtcagtctcgggacctcccttccgtctgggcgtgtgtccgcccccggccggcttcctcccgtcgggctcgggtcgaccccaccgtcccgctccgccccgggtcctccctcccagcttccctccggtctatttttctgtctctgggcccctcgttctctttgtttttggactccccagtttcctctgtcttttgacccccccgcccccaccctgactctccctggaacccccacgtttctcgttgtctttctggaacgccgaggcaggtccctcctattttccaaaccccctcctttcccactcctccacaccacccttttctactccagccctccttcttctgtctttggttaccgcgtcccacaacctgcaccacagtcctctgtcttagggtcatctacccagcccctggcctccagcctctccctatcactgcctcttatctgtcagcggactcccgcacctccagattctcagggtcctctccccgacttggcctcaggttttggggggcctctatagtcaagtctgtcctggtcgtcttccccactcctgcccataccatcccggctttcccctgcctgcctgtctctagtttctctcacatccctttttttttttcctttctctagccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgcac

SEQ ID NO: 129283 - DNA, 597 bp, Homo sapiens
  Payload ID: 5290
  Gene Symbol: EGLN2
  Gene Name: egl-9 family hypoxia-inducible factor 2
  ENST ID: ENST00000594380
  CDS Start-End: 335-597
gtcagtctcgggacctcccttccgtctgggcgtgtgtccgcccccggccggcttcctcccgtcgggctcgggtcgaccccaccgtcccgctccgccccggccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagct

SEQ ID NO: 129284 - DNA, 935 bp, Homo sapiens
  Payload ID: 5290
  Gene Symbol: EGLN2
  Gene Name: egl-9 family hypoxia-inducible factor 2
  ENST ID: ENST00000593972
  CDS Start-End: 517-935
acgttgggtgccggccgttgtgggggttggggtgggggcggggagcgcgcgccgggcggaggccgagtggagggggaggggagggggtccgagcggcccttaggccctgcccctgtcgcctactgcgctcagaaggggcctcagggcctgccccgggttgggggcgttggggtgccctggatgggggcacctttatctctcgtcctgtctccgggtgcgtgcaccctcctccgtcctttcctctgtcgccgcggaccctctccccgagggcccctcccgtcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaaga

SEQ ID NO: 129285 - DNA, 590 bp, Homo sapiens
  Payload ID: 5290
  Gene Symbol: EGLN2
  Gene Name: egl-9 family hypoxia-inducible factor 2
  ENST ID: ENST00000598654
  CDS Start-End: 288-590
aggatgcaaatgaacctcgtgtaggccacggaccgctgtttcctttctccttgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcacc

SEQ ID NO: 129286 - DNA, 477 bp, Homo sapiens
  Payload ID: 5290
  Gene Symbol: EGLN2
  Gene Name: egl-9 family hypoxia-inducible factor 2
  ENST ID: ENST00000595051
  CDS Start-End: 1-156
ccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagaagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 129287 - DNA, 758 bp, Homo sapiens
  Payload ID: 5290
  Gene Symbol: EGLN2
  Gene Name: egl-9 family hypoxia-inducible factor 2
  ENST ID: ENST00000595621
  CDS Start-End: 1-290
atggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctaggtacctgcttccctcccttcagtccttcctattctgtgggccctcttgggcctgatgccaccccatccccctcatcagcctcttgttaaatcccaccactcatttttcttcatctctgcccaccttccttagcccactctcctggtaccccaacaggagccccatttcttcctggtcctctccccatctccccaggtttcccttggcttctttgtccttctgatgactcactgtctcctgtcccctctcacccccagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaa

SEQ ID NO: 129288 - DNA, 572 bp, Homo sapiens
  Payload ID: 5290
  Gene Symbol: EGLN2
  Gene Name: egl-9 family hypoxia-inducible factor 2
  ENST ID: ENST00000593397
  CDS Start-End: 356-572
agtctcgggacctcccttccgtctgggcgtgtgtccgcccccggccggcttcctcccgtcgggctcgggtcgaccccaccgtcccgctccgccccgggtcctccctcccagcttccctccgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactg

SEQ ID NO: 129289 - DNA, 991 bp, Homo sapiens
  Payload ID: 5290
  Gene Symbol: EGLN2
  Gene Name: egl-9 family hypoxia-inducible factor 2
  ENST ID: ENST00000594140
  CDS Start-End: 100-477
agggggagaccagaagggctgagtggcccagatgggacactgctctgagcctcaatttgctgatccacggaatacgaaaaccaggttacatccccagccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggag

SEQ ID NO: 129290 - DNA, 574 bp, Homo sapiens
  Payload ID: 5290
  Gene Symbol: EGLN2
  Gene Name: egl-9 family hypoxia-inducible factor 2
  ENST ID: ENST00000596517
  CDS Start-End: 373-574
atttttctgtctctgggcccctcgttctctttgtttttggactccccagtttcctctgtcttttgacccccccgcccccaccctgactctccctggaacccccacgtttctcgttgtctttctggaacgccgaggcagccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacag

SEQ ID NO: 129291 - DNA, 459 bp, Homo sapiens
  Payload ID: 5290
  Gene Symbol: EGLN2
  Gene Name: egl-9 family hypoxia-inducible factor 2
  ENST ID: ENST00000597746
  CDS Start-End: 1-387
attgcctgggtggaaggccatgaaccaggctgtcgaagcattggtgccctcatggcccatgtggacgccgtcatccgccactgcgcagggcggctgggcagctatgtcatcaacgggcgcaccaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgct

SEQ ID NO: 129292 - DNA, 2709 bp, Homo sapiens
  Payload ID: 5291
  Gene Symbol: EGLN3
  Gene Name: egl-9 family hypoxia-inducible factor 3
  Uniprot ID: Q9H6Z9
  ENST ID: ENST00000250457
  CDS Start-End: 330-1049
ccggagtctggccgcagtcgcggcagtggtggcttcccatccccaaaaggcgccctccgactccttgcgccgcactgctcgccgggccagtccggaaacgggtcgtggagctccgcaccactcccgctggttcccgaaggcagatcccttctcccgagagttgcgagaaactttcccttgtccccgacgctgcagcggctcgggtaccgtggcagccgcaggtttctgaaccccgggccacgctccccgcgcctcggcttcgcgctcgtgtagatcgttccctctctggttgcacgctggggatcccggacctcgattctgcgggcgagatgcccctgggacacatcatgaggctggacctggagaaaattgccctggagtacatcgtgccctgtctgcacgaggtgggcttctgctacctggacaacttcctgggcgaggtggtgggcgactgcgtcctggagcgcgtcaagcagctgcactgcaccggggccctgcgggacggccagctggcggggccgcgcgccggcgtctccaagcgacacctgcggggcgaccagatcacgtggatcgggggcaacgaggagggctgcgaggccatcagcttcctcctgtccctcatcgacaggctggtcctctactgcgggagccggctgggcaaatactacgtcaaggagaggtctaaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttacttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagccccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtgggtgttcctgttttttttttttttttttttttagttttcctttttaatgagctcaccctttaacacaaaaaaagcaaggtgatgtattttaaaaaaggaagtggaaataaaaaaatctcaaagctatttgagttctcgtctgtccctagcagtctttcttcagctcacttggctctctagatccactgtggttggcagtatgaccagaatcatggaatttgctagaactgtggaagcttctactcctgcagtaagcacagatcgcactgcctcaataacttggtattgagcacgtattttgcaaaagctacttttcctagttttcagtattactttcatgttttaaaaatccctttaatttcttgcttgaaaatcccatgaacattaaagagccagaaatattttcctttgttatgtacggatatatatatatatagtcttccaagatagaagtttactttttcctcttctggttttggaaaatttccagataagacatgtcaccattaattctcaacgactgctctattttgttgtacggtaatagttatcaccttctaaattactatgtaatttattcacttattatgtttattgtcttgtatcctttctctggagtgtaagcacaatgaagacaggaattttgtatatttttaaccaatgcaacatactctcagcacctaaaatagtgccgggaacatagtaagggctcagtaaatacttgttgaataaactcagtctcc

SEQ ID NO: 129293 - DNA, 2849 bp, Homo sapiens
  Payload ID: 5291
  Gene Symbol: EGLN3
  Gene Name: egl-9 family hypoxia-inducible factor 3
  ENST ID: ENST00000547327
  CDS Start-End: 330-776
ccggagtctggccgcagtcgcggcagtggtggcttcccatccccaaaaggcgccctccgactccttgcgccgcactgctcgccgggccagtccggaaacgggtcgtggagctccgcaccactcccgctggttcccgaaggcagatcccttctcccgagagttgcgagaaactttcccttgtccccgacgctgcagcggctcgggtaccgtggcagccgcaggtttctgaaccccgggccacgctccccgcgcctcggcttcgcgctcgtgtagatcgttccctctctggttgcacgctggggatcccggacctcgattctgcgggcgagatgcccctgggacacatcatgaggctggacctggagaaaattgccctggagtacatcgtgccctgtctgcacgaggtgggcttctgctacctggacaacttcctgggcgaggtggtgggcgactgcgtcctggagcgcgtcaagcagctgcactgcaccggggccctgcgggacggccagctggcggggccgcgcgccggcgtctccaagcgacacctgcggggcgaccagatcacgtggatcgggggcaacgaggagggctgcgaggccatcagcttcctcctgtccctcatcgacaggctggtcctctactgcgggagccggctgggcaaatactacgtcaaggagaggtctaaggtaggacgcgctcggcgccctgccgcagctgctcccgcggggacgggaggcactcggagtccgttgtatgtcgacttcccagggccgtaagcgaactttgttttttaaccaagaagtcagcctggtttgtctctactcgctgcttccccccacccctcgccccagctcctctgagcgaaagtcaacgttaaggggctcaggtgaaccatgatgatgaccttctgttgactttgaaatattggctcttgtgggtgacaaaagccagacaagctgtggctgtggtccgattttaagacgaggttctcaaagatccaaaggagggaaagggtattggaaacactgtgtatcatctgagacacacgtgtcctcatgatcttaaatgcctactttaaagccacctaatactgcccttcattgtggtcagaagagatttctacaaaagcactcagaattctggaggcagttgtgattttgccatgtggcagttggtttgtggagttgggcaggtgtgaaagggtaaaactccacttctgaatgctgcttctgccccctgggacccagcacattgttagaccatcttcttgactgaaaattctctcctgatgctgagccctgcaccaccaccttccttttcctaactatgaattgatggcaaagtccactcaaaacaaccagttaagtgctcacgagagagtagtcaagcacctccagaaagaaaccgggtttttgttcacatagcaggaagtgactccctgggtggtaatttatcttggaaacacaggtagattggcagaaaaacgggaacatgtaggtaccgcgatgttggtgcatgtccattactttgggataggctttctcagtctttcctcaaatgatagttgagccagttttccagtggcaattctgagtgacttgcgcttgtcttatggtgtggtcaagggacgttcagaactacggaaaacttttactgaaacagcgaagcagagtataccggcatgagagggaagatgaacactcacctatgtaccactctttgacaataaatatagtatttctcaaatcagtctcaagactgatcctgtctcagaacagaccattgttctctcatttctctaatacgctgagaggaacactctgaataaaggctaagtggtgaggattggaaacgtgtgggagtgaaggggtggaggtggatgagtgcagtggggagtcacagtttgccgtacaacttccaagccaagaggccatgaatagaatatctgaaagcatcgttattaatgcacccaagtaaagtaaatcttagaagatactgctttctaaattttactttggggaaaaaaattccgcgtgagctgaactctgtaggagattgatgctaaagtgtttctttattcttcttccatcatgttggtggtggattagtcactcgtctttgactagtttgatttttgcattaaatgaccttgctgtcttctgtggtggaggtgtgtcggggaggggaagggtcagcctcagtgttgctgagatgctggtagtttctacctggaagagcagacggcttcttattgggtttttaaatgtttcttgtaaatttaggtgttaggagtttttcttcatcattctaggagcagaatttgctctgagggaggtcaggattaattggtatggaaagaggccactaacattgaaagttaaatatttttatttagctttgacttaatggatagggatagggtttcagactagaatttaactcaaatggaaggaaaaacactgtgtaagttagggtaagggaaagaaagatcctgtagatatgattcatcaattttaggttatcttttgggtggaatgaaaaactttccaggtgaccctgtcagaaggtgatcgtgaattgaaaataaaatttatcctgtcccacccccagatttccaggtttactttggctggtttgtcacaaagctccctgccctttagataaatcacctttcgattggaatattccctggccaattagaaccaaatgcaaaccaggcttgagcaaacaactagtgtagttaaattttttttaagtgtgctttgcttgtatacagaagtctccttagtgatgtcttgtggtcttgggtttcttgtttgaagttcattattaaagtcatggtagaaaca

SEQ ID NO: 129294 - DNA, 1004 bp, Homo sapiens
  Payload ID: 5291
  Gene Symbol: EGLN3
  Gene Name: egl-9 family hypoxia-inducible factor 3
  ENST ID: ENST00000553215
  CDS Start-End: 75-512
ggcttcgcgctcgtgtagatcgttccctctctggttgcacgctggggatcccggacctcgattctgcgggcgagatgcccctgggacacatcatgaggctggacctggagaaaattgccctggagtacatcgtgccctgtctgcacgaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttacttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttgggg

SEQ ID NO: 129295 - DNA, 848 bp, Homo sapiens
  Payload ID: 5291
  Gene Symbol: EGLN3
  Gene Name: egl-9 family hypoxia-inducible factor 3
  ENST ID: ENST00000487915
  CDS Start-End: 612-848
acaccctcaaagatcagccaggggaaactacttctggtttctgcagctttcatctaggaagaggtgggctggatacacccactcgtttcccaccatctccagaaggagcagctttaactatgactcagtgatgcagggcttctgaccacaacctaaaaatgaaaggccctatcaccaatcttatctgctcatcaaaaaacagacggtggtgatatgcagtcaagcttgctggtacttccaatgcctgccctgagaaggttctgccatggagatgaagacacgctggagccacaggagtggttctggaacatctaaccttcttgtgcaaagtttctatcataacttgagattagacatgctcttattaggaaagttgcagctaccaggaggcagcctgaacgtgtcagggcctgggcacgacacttgcctttcttggaggagtgatttgaagccatagtggaagactgagcctctataaaaaatgaacgaggacactcttaatggacagatacaaaacaagccccaggagaaaggtgttgttatgtccaaagccatcttgccatgcgcagcctgagaatggagccaatgactgagggtggcagagcagaaagatggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaa

SEQ ID NO: 129296 - DNA, 5165 bp, Homo sapiens
  Payload ID: 5292
  Gene Symbol: EHBP1
  Gene Name: EH domain binding protein 1
  Uniprot ID: Q8NDI1
  ENST ID: ENST00000263991
  CDS Start-End: 483-4178
gggcgccgtccgcctgaggggctgcagatcccggctaccgcgagcgccgtggctggcttggctgttccatgtggctccggcggggatggaggactcggtggcggcggcggctgctgctgcggcggcgacggaggagcggctatgagaagggaacggggccagactcagcccgacagcgggattagagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagaaattgtaaaccagttgaatgctctgagcagcttagatgaagatcaagatgactgcataaagcaagcaaatatgcgttcagctaaatcagccagttcctctgaagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagatgaaaatgataatattgagatagatactaacgaggagatccctgaaggctttgttgtaggaggtggagatgaacttactaacttagaaaatgaccttgatactcccgaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttaccttaaa

SEQ ID NO: 129297 - DNA, 4108 bp, Homo sapiens
  Payload ID: 5292
  Gene Symbol: EHBP1
  Gene Name: EH domain binding protein 1
  Uniprot ID: Q8NDI1
  ENST ID: ENST00000405015
  CDS Start-End: 529-4011
aactgggaggctccccagtttgtgggtaacatctgactctccctccccaaagagagactccagcgagagactggggatttggaggtccaagtcatggcagaactgggttgcttgctaggacacaaggttagcatgcccctgtagcagcaatgtgagaatcagaaaaggtgactgtgcatctcaagaagccgaatcaaaaagccaagccaaccacctaaccagtgattttcaagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattt

SEQ ID NO: 129298 - DNA, 1311 bp, Homo sapiens
  Payload ID: 5292
  Gene Symbol: EHBP1
  Gene Name: EH domain binding protein 1
  ENST ID: ENST00000405482
  CDS Start-End: 381-1311
acgcgcggggcctggccaatggcggcggggcggtggaggttgagctgccgtgggtagggttagtgtgagaggtgcggcgggggagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataa

SEQ ID NO: 129299 - DNA, 3591 bp, Homo sapiens
  Payload ID: 5292
  Gene Symbol: EHBP1
  Gene Name: EH domain binding protein 1
  Uniprot ID: Q8NDI1
  ENST ID: ENST00000405289
  CDS Start-End: 1-3591
atggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagatgaaaatgataatattgagatagatactaacgaggagatccctgaaggctttgttgtaggaggtggagatgaacttactaacttagaaaatgaccttgatactcccgaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtag

SEQ ID NO: 129300 - DNA, 669 bp, Homo sapiens
  Payload ID: 5292
  Gene Symbol: EHBP1
  Gene Name: EH domain binding protein 1
  ENST ID: ENST00000422032
  CDS Start-End: 1-669
caataccaacacagccaccccattctgcaacaggcagctaagtgatcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagatgaaaatgataatattgagatagatactaacgaggagatccctgaaggctttgttgtaggaggtggagatgaacttactaacttagaaaatgaccttgatactcccgaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaa

SEQ ID NO: 129301 - DNA, 533 bp, Homo sapiens
  Payload ID: 5292
  Gene Symbol: EHBP1
  Gene Name: EH domain binding protein 1
  ENST ID: ENST00000413434
  CDS Start-End: 209-533
aacatctgactctccctccccaaagagagactccagcgagagactggggatttggaggtccaagtcatggcagaactgggttgcttgctaggacacaaggttagcatgcccctgtagcagcaatgtgagaatcagaaaaggtgactgtgcatctcaagaagccgaatcaaaaagccaagccaaccacctaaccagtgattttcaaggtatgaactggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccat

SEQ ID NO: 129302 - DNA, 586 bp, Homo sapiens
  Payload ID: 5292
  Gene Symbol: EHBP1
  Gene Name: EH domain binding protein 1
  ENST ID: ENST00000426940
  CDS Start-End: 463-586
aacatctgactctccctccccaaagagagactccagcgagagactggggatttggaggtccaagtcatggcagaactgggttgcttgctaggacacaaggttagcatgcccctgtagcagcaatgtgagaatcagaaaaggtgactgtgcatctcaagaagccgaatcaaaaagccaagccaaccacctaaccagtgattttcaaggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaag

SEQ ID NO: 129303 - DNA, 329 bp, Homo sapiens
  Payload ID: 5292
  Gene Symbol: EHBP1
  Gene Name: EH domain binding protein 1
  ENST ID: ENST00000454124
  CDS Start-End: 1-329
acttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcagcaagatgaagagcgacgtcggcagctgagagagagagctcgtcagctaatagcagaagctcgatctggagtgaagatgtcagaacttcccagctat

SEQ ID NO: 129304 - DNA, 539 bp, Homo sapiens
  Payload ID: 5292
  Gene Symbol: EHBP1
  Gene Name: EH domain binding protein 1
  ENST ID: ENST00000449820
  CDS Start-End: 255-539
aacatctgactctccctccccaaagagagactccagcgagagactggggatttggaggtccaagtcatggcagaactgggttgcttgctaggacacaaggttagcatgcccctgtagcagcaatgtgagaatcagaaaaggtgactgtgcatctcaagaagccgaatcaaaaagccaagccaaccacctaaccagtgattttcaaggaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagaaattgtaaac

SEQ ID NO: 129305 - DNA, 460 bp, Homo sapiens
  Payload ID: 5292
  Gene Symbol: EHBP1
  Gene Name: EH domain binding protein 1
  ENST ID: ENST00000444311
  CDS Start-End: 1-460
ccgattattggaaccttctgatatgacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagatgaaaatgataatattgagatagatactaacgaggagatccctgaaggctttgttgtaggaggtggagatgaa

SEQ ID NO: 129306 - DNA, 5076 bp, Homo sapiens
  Payload ID: 5292
  Gene Symbol: EHBP1
  Gene Name: EH domain binding protein 1
  Uniprot ID: Q8NDI1
  ENST ID: ENST00000431489
  CDS Start-End: 607-4089
gatgatggtggcggaggagaaaggcgggggagggggtgctgggcgctgagcggtggctctggcagggcttggtagggtgggggacggtcgcggggcgatctgtcagggagggggtgggcgtgaggggcgccgtccgcctgaggggctgcagatcccggctaccgcgagcgccgtggctggcttggctgttccatgtggctccggcggggatggaggactcggtggcggcggcggctgctgctgcggcggcgacggaggagcggctatgagaagggaacggggccagactcagcccgacagcgggattagagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttaccttaaa

SEQ ID NO: 129307 - DNA, 581 bp, Homo sapiens
  Payload ID: 5292
  Gene Symbol: EHBP1
  Gene Name: EH domain binding protein 1
  ENST ID: ENST00000427809
  CDS Start-End: 349-581
acgcgcggggcctggccaatggcggcggggcggtggaggttgagctgccgtggccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacat

SEQ ID NO: 129308 - DNA, 5185 bp, Homo sapiens
  Payload ID: 5293
  Gene Symbol: EHBP1L1
  Gene Name: EH domain binding protein 1-like 1
  Uniprot ID: Q8N3D4
  ENST ID: ENST00000309295
  CDS Start-End: 266-4837
cgggggtgcggctccaggaaacggcgcgctcccagctccgcgctcgccacccgacgcgccccaggcgaccccgcagactcagccagaccaccctgcgggccccagcggcggcagcggagagcgcggtcccgggtcggagcctgggacacctccgcacggacggggcgggcggcgcggacaggccatggggacccgggccgggccagcggtggcgggccagcgggagccccgggcctgagaagtgggcggcggggtggcgggggccatgacctcggtgtggaagcgcctgcagcgcgtgggcaagcgggcggccaagttccagttcgtggcctgttaccacgagctagtgttggagtgcaccaagaaatggcagccagataagctggtggtggtatggacccgtcggaaccgacgcatctgctccaaggcccacagctggcagccgggcatccagaacccataccggggcaccgtggtgtggatggtacctgagaatgtggacatctctgtgaccctctacagggacccccacgtggaccagtatgaggccaaagagtggacatttattattgaaaatgagtctaaggggcagcggaaggtgctggccacggccgaggtggacctggcccgccatgcagggcccgtgcctgtccaagtcccagtgaggctgcggctgaagccaaagtcagtgaaggtggtgcaggctgagctgagcctcactctttccggggtgctgctgcgggagggccgtgccacggacgatgacatgcagagtctcgcaagcctcatgagtgtgaagcctagtgatgtgggcaacttggatgactttgctgagagtgatgaagatgaggctcatggcccaggagccccggaggcccgggctcgagtcccccagccagatccctctcgagagctgaagacgctttgtgaggaggaggaggaaggccaaggacgaccccagcaggcagttgccagcccttctaatgctgaggataccagcccagcccctgtgagtgctcctgcacccccagccagaacctcccgaggccaggggtcagaacgagctaatgaagcggggggccaggtaggccctgaggccccaaggcccccggaaacctcaccagagatgaggtcttcaaggcagccagcccaggacacggcccccaccccagcccctcggctccggaaaggctctgatgccctccggcccccagtcccccagggggaagatgaggtccccaaagcctcaggggctcctccagcaggattgggctctgctagggagacccaggcccaggcatgccctcaggaagggacagaagcccatggagctaggctgggcccgagcattgaggataaaggttctggagacccttttggaaggcagagactcaaggctgaagagatggacactgaggacaggccagaggccagtggggtggacactgagccaaggtcaggaggcagagaggcaaacactaagaggtcaggagtcagagctggggaggctgaagagagttcagcagtttgtcaagtggatgctgagcagaggtcaaaggtgagacatgtggacactaagggaccagaggcgacaggggtgatgcctgaggcaagatgcagggggacccctgaggctcctccaaggggctctcaggggaggctgggagtcaggaccagggatgaggctccctcaggcctgagcctgcccccagcggagcctgcagggcactctgggcaacttggtgacctcgagggggccagggctgctgcaggccaggagagagagggtgcagaagtgaggggtggagcacctggtattgaggggacaggcctggagcagggcccttctgttggagcaataagcaccaggccccaggtgagcagctggcagggggccctgttatcaactgcccagggggcaatatccaggggtctgggaggctgggaggcagaagctgggggttcaggggacctggaaacagagactgaggtggtagggttggaggtgctgggaacccaggagaaagaagttgaggggtcagggttcccagagactaggacactagaaattgagatattgggggccttggagaaagaagcagcaagatcaagggtcctggagtcagaggttgctgggacagcacagtgtgagggactggagacccaggaaacagaggtgggggtcatagagaccccagggacagagactgaggtattggggacccagaaaacagaagctgggggttcaggagttttgcagacaagaactacgatagcagagactgaggtactggtgacccaggagatatctggggatttagggccactgaagatagaagatacaatacagtctgagatgctggggacccaggagacagaggtggaagcttctagggtaccagagtcagaggctgaggggacagaagctaaaatattagggacccaggagataacagctagggattcaggggtcagagagatagaagcagagatagcagagtctgacatattggtagcccaggagatagaggtgggacttttgggggttctgggaatagagactggggcagcagaaggtgcgatattggggacccaagagatagcatctagggattcaggggtcccagggttagaagctgatacaacagggatccaggtgaaagaggttgggggttcagaggttccagagatagcgactgggacagcagaaactgagatattggggacccaagagatagcatctaggagttcaggggtcccagggctagaatctgaggtagctggggcccaggagacagaggtcgggggttcagggatctcagggcccgaggctggaatggcagaggcccgagtactgatgacccgtaagacagaaattatagttccagaggctgagaaggaagaggctcagacttcgggggtccaggaagcagagactagagttgggagtgctctcaaatatgaggctttaagggccccagtcactcagccaagagttttaggatcccaggaagcaaaagcagagatttcaggagtacaagggtcagagactcaagttctgagagtccaggaggcagaggctggggtttgggggatgtcagagggcaaatctggggcttggggggcccaggaagcagagatgaaggttttagagtctccagagaacaaatctggtacttttaaggcccaggaagcggaggctggggtcttgggaaatgagaaggggaaagaagctgagggaagcctcacagaggccagcctgcctgaagcacaggtggccagtggggcaggggctggggcgcccagggcctcttccccagagaaggctgaagaggacaggaggctgccgggcagccaggcaccacctgccctggtcagctccagccagtccctgctggagtggtgccaggaagtcaccactggctaccgtggcgtccgcatcaccaacttcaccacatcctggcgcaacggcttggccttctgtgccatcctgcaccgattctacccagacaagattgactatgcctcgctagacccactcaacatcaagcagaacaacaagcaggccttcgatggcttcgcggctctgggcgtgtcgcggctgctggagcccgcggacatggtgctactgtcggtgcccgacaagctcatcgtcatgacgtacctgtgccagatccgcgccttctgcaccgggcaggagctgcagctggtacaactggagggcggcggcggcgccggcacgtaccgcgtgggcagcgcccagcccagcccgcccgacgacctggacgccggaggcctggcgcagcggctgcgcggtcacggggccgaggggccccaggagcccaaggaggccgcagaccgcgcagacggggcggccccgggggtggcctccaggaacgcggtcgcgggccgcgcctccaaggacggcggggccgaggccccccgagagtcgcgacccgcggaggtcccggccgaggggctggtgaacggggcgggggcaccgggcggcggcggcgtgaggctgcgacggccctcggtcaacggggagcccgggtcggtgcccccgccccgcgcgcacggctccttctcccacgtgcgcgacgcggacctgctcaagaagaggcgctcgcggctgcggaacagcagctcgttctcgatggacgatccggacgcgggagccatgggagctgcggctgcagaaggccaggcccctgaccccagccctgccccaggcccacccacagctgcagactctcaacagccccctggtgggagttccccctcggaggaaccacccccaagcccaggggaggaggctgggctgcaacggttccaggacacaagtcagtacgtgtgtgcagagctgcaggccctggaacaggagcagaggcagatagatgggcgggcggctgaggtggagatgcagctgaggagcctcatggagtcaggtgccaacaagctgcaggaggaggtgctgatccaggagtggttcaccctggtcaacaagaagaacgctctcatccggaggcaggaccagctgcagctgctcatggaggagcaggacttggagcgaaggttcgagctgctgagccgcgagctgcgggccatgctggccatcgaagactggcagaaaacgtccgctcagcagcaccgagagcagctcctactggaggagctggtgtcgctggtgaaccagcgcgatgagctagtccgggacctggaccacaaggagcggatcgccctggaggaggacgagcgcctggagcgcggcctggaacagcggcgccgcaagctgagccggcagttgagccggcgggagcgctgcgtgctgagctgaggccgccggcccgggtggcccataacttctcgcgtccccggcgtccgccgccgccccgggcctgcgctgcggacgacccggccgtcccggaggccgcgcgcgtgtccgctaggggccgccggcgcccttccccgtacagggcagggcggatccccgaccccacgggcggggcggccgccgtatttatttgtcaccgagggtgtgtgcgcgctcgcggcgggtgcggggtcctccccgacggcacggccgggccggcggcctcggggagagggatgcctgggcactaccgccccgcgctggcttgccctcctgttctccagagcaataaagttggacgagactacccca

SEQ ID NO: 129309 - DNA, 2267 bp, Homo sapiens
  Payload ID: 5293
  Gene Symbol: EHBP1L1
  Gene Name: EH domain binding protein 1-like 1
  ENST ID: ENST00000533237
  CDS Start-End: 258-2267
cggctccaggaaacggcgcgctcccagctccgcgctcgccacccgacgcgccccaggcgaccccgcagactcagccagaccaccctgcgggccccagcggcggcagcggagagcgcggtcccgggtcggagcctgggacacctccgcacggacggggcgggcggcgcggacaggccatggggacccgggccgggccagcggtggcgggccagcgggagccccgggcctgagaagtgggcggcggggtggcgggggccatgacctcggtgtggaagcgcctgcagcgcgtgggcaagcgggcggccaagttccagttcgtggcctgttaccacgagctagtgttggagtgcaccaagaaatggcagccagataagctggtggtggtatggacccgtcggaaccgacgcatctgctccaaggcccacagctggcagccgggcatccagaacccataccggggcaccgtggtgtggatggtacctgagaatgtggacatctctgtgaccctctacagggacccccacgtggaccagtatgaggccaaagagtggacatttattattgaaaatgagtctaaggggcagcggaaggtgctggccacggccgaggtggacctggcccgccatgcagggcccgtgcctgtccaagtcccagtgaggctgcggctgaagccaaagtcagtgaaggtggtgcaggctgagctgagcctcactctttccggggtgctgctgcgggagggccgtgccacggacgatgacatgcagagtctcgcaagcctcatgagtgtgaagcctagtgatgtgggcaacttggatgactttgctgagagtgatgaagatgaggctcatggcccaggagccccggaggcccgggctcgagtcccccagccagatccctctcgagagctgaagacgctttgtgaggaggaggaggaaggccaaggacgaccccagcaggcagttgccagcccttctaatgctgaggataccagcccagcccctgtgagtgctcctgcacccccagccagaacctcccgaggccaggggtcagaacgagctaatgaagcggggggccaggtaggccctgaggccccaaggcccccggaaacctcaccagagatgaggtcttcaaggcagccagcccaggacacggcccccaccccagcccctcggctccggaaaggctctgatgccctccggcccccagtcccccagggggaagatgaggtccccaaagcctcaggggctcctccagcaggattgggctctgctagggagacccaggcccaggcatgccctcaggaagggacagaagcccatggagctaggctgggcccgagcattgaggataaaggttctggagacccttttggaaggcagagactcaaggctgaagagatggacactgaggacaggccagaggccagtggggtggacactgagccaaggtcaggaggcagagaggcaaacactaagaggtcaggagtcagagctggggaggctgaagagagttcagcagtttgtcaagtggatgctgagcagaggtcaaaggtgagacatgtggacactaagggaccagaggcgacaggggtgatgcctgaggcaccacctgccctggtcagctccagccagtccctgctggagtggtgccaggaagtcaccactggctaccgtggcgtccgcatcaccaacttcaccacatcctggcgcaacggcttggccttctgtgccatcctgcaccgattctacccagacaagattgactatgcctcgctagacccactcaacatcaagcagaacaacaagcaggccttcgatggcttcgcggctctgggcgtgtcgcggctgctggagcccgcggacatggtgctactgtcggtgcccgacaagctcatcgtcatgacgtacctgtgccagatccgcgccttctgcaccgggcaggagctgcagctggtacaactggagggcggcggcggcgccggcacgtaccgcgtgggcagcgcccagcccagcccgcccgacgacctggacgccggaggcctggcgcagcggctgcgcggtcacggggccgaggggccccaggagcccaaggaggccgcagaccgcgcagacggggcggccccgggggtggcctccaggaacgcggtcgcgggccgcgcctccaaggacggcggggccgaggccccccgagagtcgcgacccgcggaggtcccggccgaggggctggtgaacggggcgggggcaccgggcggcggcggcgtgaggctg

SEQ ID NO: 129310 - DNA, 793 bp, Homo sapiens
  Payload ID: 5293
  Gene Symbol: EHBP1L1
  Gene Name: EH domain binding protein 1-like 1
  ENST ID: ENST00000533465
  CDS Start-End: 1-793
agtcagagctggggaggctgaagagagttcagcagtttgtcaagtggatgctgagcagaggtcaaaggcccaggaagcggaggctggggtcttgggaaatgagaaggggaaagaagctgagggaagcctcacagaggccagcctgcctgaagcacaggtggccagtggggcaggggctggggcgcccagggcctcttccccagagaaggctgaagaggacaggaggctgccgggcagccaggcaccacctgccctggtcagctccagccagtccctgctggagtggtgccaggaagtcaccactggctaccgtggcgtccgcatcaccaacttcaccacatcctggcgcaacggcttggccttctgtgccatcctgcaccgattctacccagacaagattgactatgcctcgctagacccactcaacatcaagcagaacaacaagcaggccttcgatggcttcgcggctctgggcgtgtcgcggctgctggagcccgcggacatggtgctactgtcggtgcccgacaagctcatcgtcatgacgtacctgtgccagatccgcgccttctgcaccgggcaggagctgcagctggtacaactggagggcggcggcggcgccggcacgtaccgcgtgggcagcgcccagcccagcccgcccgacgacctggacgccggaggcctggcgcagcggctgcgcggtcacggggccgaggggccccaggagcccaaggaggccgcagaccgcgcagacggggcggccccgggggtggcctccaggaacgcggtcgcgggc

SEQ ID NO: 129311 - DNA, 1643 bp, Homo sapiens
  Payload ID: 5293
  Gene Symbol: EHBP1L1
  Gene Name: EH domain binding protein 1-like 1
  ENST ID: ENST00000634639
  CDS Start-End: 242-1643
cgcgctcccagctccgcgctcgccacccgacgcgccccaggcgaccccgcagactcagccagaccaccctgcgggccccagcggcggcagcggagagcgcggtcccgggtcggagcctgggacacctccgcacggacggggcgggcggcgcggacaggccatggggacccgggccgggccagcggtggcgggccagcgggagccccgggcctgagaagtgggcggcggggtggcgggggccatgacctcggtgtggaagcgcctgcagcgcgtgggcaagcgggcggccaagttccagttcgtggcctgttaccacgagctagtgttggagtgcaccaagaaatggcagccagataagctggtggtggtatggacccgtcggaaccgacgcatctgctccaaggcccacagctggcagccgggcatccagaacccataccggggcaccgtggtgtggatggtacctgagaatgtggacatctctgtgaccctctacagggacccccacgtggaccagtatgaggccaaagagtggacatttattattgaaaatgagtctaaggggcagcggaaggtgctggccacggccgaggtggacctggcccgccatgcagggcccgtgcctgtccaagtcccagtgaggctgcggctgaagccaaagtcagtgaaggtggtgcaggctgagctgagcctcactctttccggggtgctgctgcgggagggccgtgccacggacgatgacatgcagagtctcgcaagcctcatgagtgtgaagcctagtgatgtgggcaacttggatgactttgctgagagtgatgaagatgaggctcatggcccaggagccccggaggcccgggctcgagtcccccagccaggccggggcggtgccctgaggccagggcgtttcccagatccctctcgagagctgaagacgctttgtgaggaggaggaggaaggccaaggacgaccccagcaggcagttgccagcccttctaatgctgaggataccagcccagcccctgcaccacctgccctggtcagctccagccagtccctgctggagtggtgccaggaagtcaccactggctaccgtggcgtccgcatcaccaacttcaccacatcctggcgcaacggcttggccttctgtgccatcctgcaccgattctacccagacaagattgactatgcctcgctagacccactcaacatcaagcagaacaacaagcaggccttcgatggcttcgcggctctgggcgtgtcgcggctgctggagcccgcggacatggtgctactgtcggtgcccgacaagctcatcgtcatgacgtacctgtgccagatccgcgccttctgcaccgggcaggagctgcagctggtacaactggagggcggcggcggcgccggcacgtaccgcgtgggcagcgcccagcccagcccgcccgacgacctggacgccggaggcctggcgcagcggctgcgcggtcacggggccgaggggccccaggagcccaaggaggccgcagaccgcgcagacggggcggccccgggggtggcctccaggaacgcggtcgcgggccgcgcctccaaggacggcggggccgaggccccccgagagtcgcgacccgcggaggtcccggccgaggggc

SEQ ID NO: 129312 - DNA, 4551 bp, Homo sapiens
  Payload ID: 5294
  Gene Symbol: EHD1
  Gene Name: EH-domain containing 1
  Uniprot ID: Q9H4M9
  ENST ID: ENST00000320631
  CDS Start-End: 256-1860
ccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctcggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagcgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggcccccaggttgagcaataagaaaccagaaccttgcggcccagtggcccgggccagttcaggccgcctccccctcctctgcctggggccattgagcccagcctccagggcccgggcgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtgcgaaagcttcgggtgcttccttgtcttttccaggggcagcagtcctgggccatcctcccctggtgtctgagggggtgatgccagcagggacagagtggcaaggcagccggggcaaggtgaccaaccctgcccagtcctgctctgctgggcagtagctgccccctcctactaagagggccaggcctgtagggaaaagggtttctggggtgatgcccccttccctgagcaaggtgggagctgagcagttcacttggggtggggaggggggaaacagttgggaggatgttgatagctgaggcctaggctggcacccctcagccacagacggatgagtgggcacctgcaggccctcggcactgggtggcatcaagtaaacaagggtttctgggctttggagccagactggctccttgctagccccaaggacggtttaagtacagggaagccgggcctctgaagacaaagcagatagcctgtgacaaacatgcaactaagggtggggccagtcaggcccaggtgatgtcacagatgggggactgtttataccagcagagggaagggtgactgattagtgacccttcataaaagggtgcagacttgaggtgccatgggtagaggctgctccagcccctctggcagaaggcaggacagaaacaagttcctgagggtttcagggacccagttgtgtgctccgagcctagctggtgtggtggtgtctggtcctatgaccagcacttgaggtgccagtggatgcttcagttgctgcagggctggccggccctccctgcgtcactcagctgccacctgtgggcattcaccctgtgccaggtggagctgcgctgtcacgatctgaggaagttcatgttcccccatttcacagagggagagtccgagactgaggactgccgaaataacaaaggtggtagaagcagatgcaaaccaggccgtccaactccagcgtgctttccatcaggttactaatccaaagcacacactaagaggaaaaaacggtagatccccccaaccccacccttagactgcagctgtactcagggctgagagacccacattaaaggttaaatgctgtcactcca

SEQ ID NO: 129313 - DNA, 3618 bp, Homo sapiens
  Payload ID: 5294
  Gene Symbol: EHD1
  Gene Name: EH-domain containing 1
  Uniprot ID: Q9H4M9
  ENST ID: ENST00000359393
  CDS Start-End: 412-2016
aaaggggtctgtgtgtggccggggaggatggcgggggagtgagccccatggaacagccaggaactgataaaagatgaggggacaaagacagtgtgtgtctgggaagctgggctgagaggaggaggtgccgccgcctgggggtactccgatgcttccggggattccgagccagctggaggaccgcacgtggcgaacggcgggcgcggcgcgtagtcagggaaccagggtgcctgactgggtgtctcgtggagccatcccgcgggggtgtgggggggccacggtgccggaaggcgcgcggcccagaggccgtctccgccgaacgcccgctcctcgccttcctaaccgcagcactttcgcgagcctccctacgaggggcggggcgaaacagcagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctcggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagcgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggcccccaggttgagcaataagaaaccagaaccttgcggcccagtggcccgggccagttcaggccgcctccccctcctctgcctggggccattgagcccagcctccagggcccgggcgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtgcgaaa

SEQ ID NO: 129314 - DNA, 1015 bp, Homo sapiens
  Payload ID: 5294
  Gene Symbol: EHD1
  Gene Name: EH-domain containing 1
  ENST ID: ENST00000421510
  CDS Start-End: 98-1015
gggccctgccccttcccagagtaaacccactgggggtctaagagtgggcgttgtcggctcccccagcttctgtcctccccagaatcttccagggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctcggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggc

SEQ ID NO: 129315 - DNA, 546 bp, Homo sapiens
  Payload ID: 5294
  Gene Symbol: EHD1
  Gene Name: EH-domain containing 1
  ENST ID: ENST00000455148
  CDS Start-End: 61-546
agagtcctcccgtctgttggaaaggcagcttcaagtctgtgtcctacagataatgggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatc

SEQ ID NO: 129316 - DNA, 534 bp, Homo sapiens
  Payload ID: 5294
  Gene Symbol: EHD1
  Gene Name: EH-domain containing 1
  ENST ID: ENST00000457202
  CDS Start-End: 90-534
agattgaccgtacgccagcctcagagagagaaggcccaggcggggaggagtaaagcctccctgggagagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagca

SEQ ID NO: 129317 - DNA, 557 bp, Homo sapiens
  Payload ID: 5294
  Gene Symbol: EHD1
  Gene Name: EH-domain containing 1
  ENST ID: ENST00000411683
  CDS Start-End: 123-557
gattctcaccagcctggacagccaaaggggtctgtgtgtggccggggaggatggcgggggagtgagccccatggaacagccaggaactggtaaggggagcagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtc

SEQ ID NO: 129318 - DNA, 1191 bp, Homo sapiens
  Payload ID: 5294
  Gene Symbol: EHD1
  Gene Name: EH-domain containing 1
  ENST ID: ENST00000433803
  CDS Start-End: 70-1191
attctcaccagcctggacagccaaaggggtctgtgtgtggccggggaggatggcgggggagtgagccccatggaacagccaggaactgcagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctcggagagatctaccagaagattgagcgcgagcaccagatctcccctggggacttcccgagcctccgcaagatgcag

SEQ ID NO: 129319 - DNA, 3336 bp, Homo sapiens
  Payload ID: 5294
  Gene Symbol: EHD1
  Gene Name: EH-domain containing 1
  ENST ID: ENST00000621096
  CDS Start-End: 84-1730
atcacccactgaagattctcaccagcctggacagccaaaggggtctgtgtgtggccggggaggatggcgggggagtgagccccatggaacagccaggaactgcagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctcggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagcgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggcccccaggttgagcaataagaaaccagaaccttgcggcccagtggcccgggccagttcaggccgcctccccctcctctgcctggggccattgagcccagcctccagggcccgggcgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtgcgaaagctt

SEQ ID NO: 129320 - DNA, 3585 bp, Homo sapiens
  Payload ID: 5295
  Gene Symbol: EHD2
  Gene Name: EH-domain containing 2
  Uniprot ID: Q9NZN4
  ENST ID: ENST00000263277
  CDS Start-End: 252-1883
gttttgaggggggcgcctcgtcccgcccctccctcctgtcctccctcccgtcctccccgctccgggccccacccggctcagacggctccggacgggaccgcgagcacaggccgctccgcgggcgcttcggatcctcgcgggaccccaccctctcccagcctgcccagcccgctgcagccgccagcgcgccccgtcggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggggcctgagcccaccaccgactgctttgtggccgtcatgcacggggacactgagggcaccgtgcccggcaacgccctcgtcgtggacccggacaagcccttccgcaaactcaaccctttcggaaacaccttcctcaacaggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtgagccggcccccctcccatggccctgctgtggctccccagctccagtcggctgcacgcacacccctgctccggctcacacacgccctgcctgccctccctgcccagctgtaaggaccgggggtctccctcctcactaccgccagacaccccggtggaagcatttagaggggaccacgggagggacaaggcttctctgtccgcccttcacacctccagcctcacgttcacttaggcacatcacacacacactggcacacgcaggcatccatccatccgtcattcattcaaatatttattgagcacctactatgtgcccagccctgttctaggcactgggcattaccatagagaacaaaatagacaaatacatctgccctcatggaaggtgacgttcccaggagagggcacctacacagtcacgcaaacacacactaattcctggcagggcccccagcccctcccctggctgagcagccctgtggctgaaatgactagcagataaacagacccccttctgctccgcttcctcctgcccagccaggcaacaccctcaaccggctccatcacatcctcaggtctcgggaccatggggggctcagaggggagacacacctactgcttcctcagatgggcccctccgcagccccttcccttgctcggggaaagcccccaattctgcccacacccatttatttccttccttccttccttcttttctttccttccttccttcttttttgtttttgcccccaattctgcccatacccatttctttctttccttccttccttcttttttgtttttgcccccagttctgtccacaccccttccctttcctgtcctgtcctttctttcttttttgatagaatcttgctctgtcgcccaggctggagtgcagtggtgagatctcagctcactgcaacctccacctcctgggttgaagtgattctcgtgcctcagcctcctgagtagctgggactgcaggcacgcgccaccacgcccagctaatttttgtatttgagtagagacggggtttcaccatgttggccaggctggtctcgaactccgcatctcaggtgatctgctcgccttggcctcccaaagtgatgggattacaggcatgagccaccgtgcccggcttcacacccatttctttaaaaaggatcccgtagcaggcagaaaagccccttccatcctgctcctctgatactgtgcccccttggagatatttccgtcctccacccacgtgtctgtggctggaactgcccagcctgctcctggccccctggaagcctccccacagctggtaatctggacttaaggattgctgggccaccgcctctctgcctaccaccattccatatttaagtggagcccctacgtagaaaggccccggggctttattttagtctccttttcagggatgtcgtgggcgggggagggggttcttggtgctacagccctctccccacccctaaagggacgccgacgctgtttgctgccttcaccacatattagtgcttgaccctggcaggggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttccca

SEQ ID NO: 129321 - DNA, 1766 bp, Homo sapiens
  Payload ID: 5295
  Gene Symbol: EHD2
  Gene Name: EH-domain containing 2
  Uniprot ID: Q9NZN4
  ENST ID: ENST00000538399
  CDS Start-End: 122-1345
agacggctccggacgggaccgcgagcacaggccgctccgcgggcgcttcggatcctcgcgggaccccaccctctcccagcctgcccagcccgctgcagccgccagcgcgccccgtcggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtgagccggcccccctcccatggccctgctgtggctccccagctccagtcggctgcacgcacacccctgctccggctcacacacgccctgcctgccctccctgcccagctgtaaggaccgggggtctccctcctcactaccgccagacaccccggtggaagcatttagaggggaccacgggagggacaaggcttctctgtccgcccttcacacctccagcctcacgttcacttaggcacatcacacacacactggcacacgcaggcatccatccatccgtcattcattcaaatatttattgagcacctactatgtgcccagccctgttctaggcactgggcattaccatagagaacaaaatagacaaatacatctgccctcatggaaggtgacgttcccaggagagggcacctacacagtcacgc

SEQ ID NO: 129322 - DNA, 538 bp, Homo sapiens
  Payload ID: 5295
  Gene Symbol: EHD2
  Gene Name: EH-domain containing 2
  ENST ID: ENST00000596225
  CDS Start-End: 1-93
aagagggcccggctggtgcgagtgagtagtcctgagggctgggcgcgcattcttggaggaggtttcctcggtcctctcctaccagtgctgtgagtccctgacttatcagggcccaggttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggt

SEQ ID NO: 129323 - DNA, 4636 bp, Homo sapiens
  Payload ID: 5296
  Gene Symbol: EHD3
  Gene Name: EH-domain containing 3
  Uniprot ID: Q9NZN3
  ENST ID: ENST00000322054
  CDS Start-End: 286-1893
aactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggacatcttcccctgaggaggagtcttcccctggggctgcgtgccgggggcgagcggcggccgcgatgttcagctggctgggtacggacgaccgccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggttcgtgtgtgcccagctacctaaccctgtgctggagagcatcagcgtcatcgacacaccagggatcctctctggggagaagcagaggatcagccgggggtatgactttgcagctgtccttgagtggtttgccgagcgggttgaccgcatcattctgctcttcgatgcccacaaactggacatctctgatgagttctcagaagtcatcaaagccctcaagaaccacgaggacaagatgcgagtggtgctgaacaaagctgaccagatcgagacgcagcagctgatgcgggtgtacggggccctcatgtggtccttggggaagatcgtgaacaccccagaggtgatccgggtctacatcggctccttctggtcccaccccctcctcatccctgacaaccggaagctctttgaggctgaggaacaggacctattcagggacatccagagtctgccccgaaatgctgccctgcgcaagctcaacgacctcatcaaaagggccaggctggccaaggtccacgcctacatcatcagctctctgaagaaggagatgccctcggtgttcgggaaggacaacaagaagaaggagctggtcaacaacctggccgagatctatggccggatcgagcgggagcaccagatctcacctggggacttccccaatctgaagaggatgcaggaccagctgcaggcccaggactttagcaagttccagccgctgaagagcaagctgctggaggtagtggacgacatgctggcccatgacattgcccagctcatggtgctagtgcgccaggaggagtcacagcggcccatccagatggtgaagggcggagcgttcgagggcaccctgcacggcccctttgggcatggctatggggagggggctggagaaggtatcgatgatgctgagtgggtggtggccagggacaagcccatgtacgacgagatcttctacaccctgtcaccggtggatggcaagatcacaggcgctaatgccaagaaggagatggtgcgctccaagctgcccaacagtgtgctgggcaagatctggaagctggccgacattgacaaggatggcatgctggacgacgacgagtttgcactggccaaccacctcatcaaagtcaagctggaggggcacgagctgcccaacgagctgcctgcccacctcctgcccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccatgtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatccattcaagagctaggagatctgagggcaggcgggcagctgcagggaggagaggtgagaaaggaagcgtcttctagagacattggcccaggagctctgttctttcctaatctaagcctctgtcttcttcggcaaaccttgctttgaactctgccagtatttcattttaaagaatcccagagcgggagagagaagagaaaaaaattgataagagtgaggaaattgtcctgtagtctattgaaaaccagtcaaggtggttttagttcatagattttgttagatgttctttccacctggcctatgatgtttagatgttcatacttgactcacatttacccagcccctcctgcgtaccaggagctgtgttaggcactttatatacattattctatgtggccctcactgatgccccagggaagtatgcattagccttcccattttgcagttgaggaggctgagtagcctcagaagggtttaggcgaccttctgaaactcacagaagtcacgtgatggagagaggattcaaagccagggcctcagaccctcacacacttgtctgtgctatgatgtatgcaggatcccagcattgatacccaatgacaaactatggagaacaagcaaagtatgcaggccccctgcagcctcccaggacaggctggcaagggaggagggccggccagcatttggtggcccatcagtctggccatctgtcacgtcacagaagcaaaccgtgccttctggctctgcgccccatattcccagcatcatagacatccaacagcaccagcaggagagtgggctagcctgctggatgctgttcgtgcctgtccctgctctgcctcccacccagttgcctgaatcatcccagctcagatgcagccactgtctcttgtcaagtgggacctcatactattctcagaaggctaacttgagaggtttggggccttgttccccagagggtccccagggactctgcagtgtccttggcaaatccccactgtactcaatgccctacattctcttctgtggtctctcccctggcttgcttcatggccactgaaccaatcactttgtatgctatgctcctactgtgatggaaaacaaaatgagtataacttattttatatccatattcagactatatagagaatattctatgcatctatgacgtgcttactactgcagtgcatttgtcattagtcttcatgttaatacagtacatttattctttggtacctgcctggccacagagcatcattcaatggaggctgagggagaagggctgggttcttacttggagttcctggtgaaatctttggctggaaagggctcactggggccacccaatggccagcatccacaaccagcttcccagtgggctggagtttgtctaggctcagtgaccaacccaggcacagctggtggagccaccgctccctgctcctctggagtgaagatgttccctaagcccctgggcttccttctgcaaatacacatttctctttcacatgaaatgaagggcagacaaaggccaggcaaagaggtctcacctgctctggagaaaacccttgagtgccgagtgcaggttagggaccatttctcaactccacacctttcttcaagctgaaggagaaatgggaaggaaatagcagaggtaggtgaagttcctgtctttttattttataggaaagggagatgtctgttatcccctttcttcactgccactggacacacatgccactttcctgcccttctacatatgctgcctctcttccctctctccatcttgaagtctccacccaggagagacctgtgaggtgtgggaattccatgtttgcacagctcccatctccctggaaagaggaactgatgtttgaggggacagatgtgggtcactttccctggcagtgccctctagccttgctgccttggctttctgaccccttccaggcttcaggggcctgggagatctcatgcctcagcccaggaaacatttaatagggaaagcagagacatgtcatgtcagccccacagacaagaatttctagagcacttgtcctgttgttccttgccccgacattactcagtctgggccatggaatccatccaataaacacagcaacaccctatgctactgaccaagcaaagcttgcccctggtaccaaagagctaaatcatgaccaaagtgtgacatgaatgtaactgaaatgcgggttagttgctcaatgtatgcaaagtcccacggacaagagtaaagtctgataccaataaagtgaatgtattccaaa

SEQ ID NO: 129324 - DNA, 2281 bp, Homo sapiens
  Payload ID: 5296
  Gene Symbol: EHD3
  Gene Name: EH-domain containing 3
  ENST ID: ENST00000541626
  CDS Start-End: 45-1685
agtcttcccctggggctgcgtgccgggggcgagcggcggccgcgatgttcagctggctgggtacggacgaccgccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggttcgtgtgtgcccagctacctaaccctgtgctggagagcatcagcgtcatcgacacaccagggatcctctctggggagaagcagaggatcagccgggggtatgactttgcagctgtccttgagtggtttgccgagcgggttgaccgcatcattctgctcttcgatgcccacaaactggacatctctgatgagttctcagaagtcatcaaagccctcaagaaccacgaggacaagatgcgagtggtgctgaacaaagctgaccagatcgagacgcagcagctgatgcgggtgtacggggccctcatgtggtccttggggaagatcgtgaacaccccagaggtgatccgggtctacatcggctccttctggtcccaccccctcctcatccctgacaaccggaagctctttgaggctgaggaacaggacctattcagggacatccagagtctgccccgaaatgctgccctgcgcaagctcaacgacctcatcaaaagggccaggctggccaaggtccacgcctacatcatcagctctctgaagaaggagatgccctcggtgttcgggaaggacaacaagaagaaggagctggtcaacaacctggccgagatctatggccggatcgagcgggagcaccagatctcacctggggacttccccaatctgaagaggatgcaggaccagctgcaggcccaggactttagcaagttccagccgctgaagagcaagctgctggaggtagtggacgacatgctggcccatgacattgcccagctcatggtgctagtgcgccaggaggagtcacagcggcccatccagatggtgaagggcggagcgttcgagggcaccctgcacggcccctttgggcatggctatggggagggggctggagaaggtatcgatgatgctgagtgggtggtggccagggacaagcccatgtacgacgagatcttctacaccctgtcaccggtggatggcaagatcacaggcgctaatgccaagaaggagatggtgcgctccaagctgcccaacagtgtgctgggcaagatctggaagctggccgacattgacaaggatggcatgctggacgacgacgagtttgcactggccaaccacctcatcaaagtcaagctggaggggcacgagctgcccaacgagctgcctgcccacctcctgccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccatgtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatccattcaagagctaggagatctgagggcaggcgggcagctgcagggaggagaggtgagaaaggaagcgtcttctagagacattggcccaggagctctgttctttcctaatctaagcctctgtcttcttcggcaaaccttgctttgaactctgccagtatttcattttaaagaat

SEQ ID NO: 129325 - DNA, 6416 bp, Homo sapiens
  Payload ID: 5297
  Gene Symbol: EHD4
  Gene Name: EH-domain containing 4
  Uniprot ID: Q9H223
  ENST ID: ENST00000220325
  CDS Start-End: 85-1710
ccagcgcggccggggcggctcagtgcgagccggggagagtcgaacccggagcagggtcccatccgagcgtggactggcggcaggatgttcagctggatggggcggcaggcgggcgggcgcgaacgcgctggcggcgcggacgcggtgcagacggtgacgggcgggctgcgctcgctctacctgcgcaaggtgctgccgctggaggaggcgtaccgcttccacgagttccactcgcctgcgctggaggacgccgacttcgagaacaagcccatgatcctgctggtgggccagtacagcaccggcaagaccaccttcatcagatacctactggagcaggatttcccaggcatgaggattggtccggagcccaccacagactccttcatcgccgtgatgtatggagagactgagggcagcaccccagggaatgctttagtcgtggaccccaaaaagccgtttagaaagctcagtcgctttggaaacgctttcctgaatcgattcatgtgctcacagctccccaatcaggtcctgaagagcatcagcgtcatcgacagccccggcatcctttctggggagaagcagcgcatcagccgaggctatgacttctgccaggtcctgcagtggtttgccgagagggtggacaggatcatcctgctctttgacgctcacaagctggacatctcagatgaattctcagaggccatcaaggccttccggggccaggacgacaagatccgtgtcgtgctgaacaaggccgaccaagtggacacgcagcagctgatgcgggtctacggggccctcatgtggtccctaggcaaggtcatcaacacgcccgaggtactgcgcgtctacattggctccttctgggcgcagcccctgcagaacacggacaaccgccggctcttcgaggctgaggcccaggacctctttagagacatccagagcctcccccagaaggcagcggtgcgcaagctcaacgacctcatcaagcgagcgaggctggccaaggtgcatgcctacatcatcagctacctgaagaaggagatgccaagtgtatttggaaaggaaaacaagaagagagagcttatcagcaggctaccggaaatctacattcagctacagcgagaataccagatttctgcaggggacttccctgaggtcaaggctatgcaggaacagcttgagaactatgacttcaccaaattccactcgctgaagcccaagctgatcgaggcagtggacaacatgctgagcaacaagatctcgcccctcatgaacctcatcagccaggaggagacgagcacgcccacgcagctggtgcagggcggcgccttcgatggcaccaccgagggccccttcaaccagggctacggggagggtgccaaggagggcgccgacgaggaggagtgggtcgtggccaaagacaagcccgtctacgacgagctcttctacactctgtcgcccatcaatggcaagatatcaggtgtcaacgccaagaaggagatggtgacctccaagctgcccaacagcgtcctgggcaagatctggaagctggccgactgcgactgcgacggcatgcttgatgaggaggagttcgcgctggccaagcacctcatcaagatcaagctcgacggctacgagctgcccagcagcctgcccccccacctcgtgcccccctcgcacaggaagtccctgcccaaggccgactgaggggtgggctgcagaacggggtgggaactgggggacctgggcctcaggcctgctccaccactgactcaccgaatgaccttgggcaaggcactgccctctctgtgccttggtttccccatctgtagaatggggagggtggacactggaaactagatgacttctttcacctccaaaattcccttagtttctatgaaaatattgggggtaggggggtggattaggagattgaagggttgagaagaaagagaaattgtccaaagagtcctcagaacctgcctggagaaatgcgcatgggggtgggcctggtaagtcccaggaaccacaggaagtgagctaaggctcacccagagcagctgggtctccaggctgcctgggctttttgtcctcatgaacaactctggagcagctgtctgtccctcagagggcacctggaggcagcaaagattatcttatttattttattttgttttctgctatatttagagtggcaaaaaaatagagcagagggtttctgctgtctccagactgtctaccaaagagaaggcgacagatgcctcctgggtttggaagggggatgcactgtggatctgccatccattctgcagtctccagcagagcaggcagtcaggccccagcgtgcctccatcccagtgccccgatgaccatctggtcagccctcccaacctcccttccagggggcttaccagcaaagccatattcggctaggaatttggaattcacaacctttattaacccctggcaaaacttcccgtttgcatgtcaaatcacattgaagcctgaaaattagcttttcttactggtttttccaataagtaatagcaaagcccacttatcatacttaaactacagtaaagaaaagaggtggttctctgcagtgatcgtttagtgtggccctcaaacattaaatatcccgaggtctccttggtgggtggcaggatttaaattcaatcaaatcctgtcctagtgtgtgcagtgtcttcggccctgtggacacaggtgaatgagggaccagccctgccctgggctgttgagaagagatcagtccacccagagttagacattgtttttgtagaaaacaggcatttattatgtctagggttttgtgttttttttttttccttacaggataaaagcctttatacagaaacaaaatggaacctttcatataaaaccttttctttaaaggctgtgtggttcgtatcatgaatgcccatcacgaggcaggattcgggcacatacctgtacttctgctccagagtgtgcgctccccaaatcccctgagtaaacctctctggactgctgctcagacacctgcgtcaggtggaggtgcctccccctctgtgggcaccagcttggggaggtaggtgacttttccttgcaaatctccctgcctcatctccagaaaattgcatacctgcatggcctctctgcattatttatgcaggaagagacacgaaacagcaatggccacatggtatgggggcctgctggcaccagaagtgaatgaaatcagaaccgtcccactgagtcttccaaaaggcacataattttttttttctgtcacctgcctttggtgacagggtcaaaggcacagattgaagagaaaatcttgatttgggagaagcatttatatccagatgcctacccttacactccctagcttactttctacataatttagttttaagagcaggaaatgcataacatggtttttagtcttaacaagcacttaaattcattagacgcatagaaaagaaccatttattattttattatttttatttttattttgagaggaagtctctgtcacccaggctggagtgcagtggcgcaatctcagttcactgcaacctccgcctcccaggttcaagtgattcccctgcctcagcctcccaagtagctgggactacaggcacccgccaccacgcccggctaatttttgtattttagtagagatggggttttaccatgttggtcaatatggtctcgatctcctgacctcgtgatctacccacctcggcctcccaaagtgctgtaacctaagcagacagttctgtgaatgcgtgaggaccacctgaagtctgcagccacggtggaggtcaccaaagggtgaactgagagagaagagggaattcacttgcccaaaggtttacagatgcccaggcaaactgatttttccatccagaattatcttgttctttaactctcctcaattgtcatatataaacatgaatttatatacatgtgtgtcacatgagtatgtcgttttaaaacaacgtgtacatatgtaagttttgtctggatacagaaagctgctttagagggcagcaggttgaggtctctgatttctccgtggaggaaaacctctcaggcactgtgatctccctacctctgcgctctcaggtgggagaggcgtcaggcagcggagtcctttccctgctggcacctggtaatgttcttggagagaaaggaaaaaaaaaggaaatcatttggccacttttcttaatatcctcttacatgcagtcattcatcaagaaaagttgactggaaaagaaaacactagaaaatatgagggatggcgaccaagtgaggacttgtatcttcccaggaccagtacaaagttctgtgaatgtgtccacaccaccagctgtctccctaccccacacggcagggcggcagggccgaccctggggcctgctcaccatcaccgttgcccttcctgcaccaccccaattttcaaagaacctcttccacagagtgtttatgtataggagagagggtggaagtacctaaactctagaactacaacatctaagaagctgaggccctgttttctacacagcatatggtatcgcataacacaaaccttccggtcttgagtttaaagggaaaatgaaaactccagcctattgctcccacagtctgcttccaagttgtcagcctgccagtgagggtctcctgaccccgtttgtagagaaacactgcactaagacttgggaatctccccagctcccagggaggggtggcacacaacagccttccaacctgcttccgcctcctgctccagccctgcagcgtctgtcaattcatttctcaactcaccgcacttggatggcctgggggcagggttgctcttctgggggagggtcattcattcagttggcttttggctttcctttctccgggctgggcctggttctcttttgaacacttgtcgtgctgcagcaagagcatctttggatttggggctgtggagctgtggttcacccgcgggagtcacagccgcggcctggacctttccacctcgcaccctcgctcaccctccttcatgatgcctggaggatgcctgagacaattgccttgaagatgaggaaagtgtttcactgtttattttctccatgggatgtagcaggcaagcatgcttaggacagaaaaccactgagtttactcaggtaaatgcgggcctaatacaagagtattgggttccaatgttggttaaccaatgcagttaatacgcaatgcttctattttttttctttttgtaatcttatttagaagtttcaaacaaaaagacatagtctgctgatcaataaacatggagctgccctctcccactggctcattttccagtggctgcgtgctggcctctcggagcagagtgtggatccctggatccaggttgaaccgggggagaagagttagggagagggtgtgcctgtgagccccaactcttcctgtggagagaaacccaaaatgcagccgcttcagaaggaaagcggccccatcaggtggggacagaagagggtaggcagcagaggccaggtctgtggacaaaagccccacttcagagtggttggaagccaggacaggagggactcatggaggtgaccgcttcacaggagtcctttctccagtcgtgctagggaggagcccctgcctgtccagcactgcccctgcctcttgctgtaccttgccagtgtgccctccccccgcccactaccatagtaggcatctggcttttcccaccaacccatctacctttttggtggtccagacctacagtctccttgcagagcactcctcctcccaccctcacttcaagtgaggtttggatgagattgaccacatccccttggtcacaaatattggctcaggaatggacatgtggccctgttcaagcctatgagagccaggacccccagacttatgttagaactcttgagagagatactctgtcttctctgaaccttgcagtatatagaaatgagcctattgatgcaacaatataaatggcactgagaggggtgtccagagctgctggggtcaggggagggaggtcagcctggcagaagccatcttgtggagcatgaaaatgaaagagaccttgagaaaggccagaggaatccaggcctgtggtgacaacatttgagctgctggatcaaacctcacctgaagtccttcctattcctactagatatttttttccactgtgtgggccaatgcattccctttatactgtgtaagccaggcatggtggctcacacctataatcccagcaatgcaggaggctgaagtgggaagatcgttgaggccaggagttcaagaccagcctgggcaacctaagaagaccctgtctctaaaaaagaattaaatataaataaataaataataaaaatataatgttt

SEQ ID NO: 129326 - DNA, 1982 bp, Homo sapiens
  Payload ID: 5297
  Gene Symbol: EHD4
  Gene Name: EH-domain containing 4
  ENST ID: ENST00000612090
  CDS Start-End: 52-1674
ggagagtcgaacccggagcagggtcccatccgagcgtggactggcggcaggatgttcagctggatggggcggcaggcgggcgggcgcgaacgcgctggcggcgcggacgcggtgcagacggtgacgggcgggctgcgctcgctctacctgcgcaaggtgctgccgctggaggaggcgtaccgcttccacgagttccactcgcctgcgctggaggacgccgacttcgagaacaagcccatgatcctgctggtgggccagtacagcaccggcaagaccaccttcatcagatacctactggagcaggatttcccaggcatgaggattggtccggagcccaccacagactccttcatcgccgtgatgtatggagagactgagggcagcaccccagggaatgctttagtcgtggaccccaaaaagccgtttagaaagctcagtcgctttggaaacgctttcctgaatcgattcatgtgctcacagctccccaatcaggtcctgaagagcatcagcgtcatcgacagccccggcatcctttctggggagaagcagcgcatcagccgaggctatgacttctgccaggtcctgcagtggtttgccgagagggtggacaggatcatcctgctctttgacgctcacaagctggacatctcagatgaattctcagaggccatcaaggccttccggggccaggacgacaagatccgtgtcgtgctgaacaaggccgaccaagtggacacgcagcagctgatgcgggtctacggggccctcatgtggtccctaggcaaggtcatcaacacgcccgaggtactgcgcgtctacattggctccttctgggcgcagcccctgcagaacacggacaaccgccggctcttcgaggctgaggcccaggacctctttagagacatccagagcctcccccagaaggcagcggtgcgcaagctcaacgacctcatcaagcgagcgaggctggccaaggtgcatgcctacatcatcagctacctgaagaaggagatgccaagtgtatttggaaaggaaaacaagaagagagagcttatcagcaggctaccggaaatctacattcagctacagcgagaataccagatttctgcaggggacttccctgaggtcaaggctatgcaggaacagcttgagaactatgacttcaccaaattccactcgctgaagcccaagctgatcgaggcagtggacaacatgctgagcaacaagatctcgcccctcatgaacctcatcagccaggaggagacgagcacgcccacgcagctggtgcagggcggcgccttcgatggcaccccgagggccccttcaaccagggctacggggagggtgccaaggggcgccgacgaggaggagtgggtcgtggccaaagacaagcccgtctacgacgagctcttctacactctgtcgcccatcaatggcaagatatcaggtgtcaacgccaagaaggagatggtgacctccaagctgcccaacagcgtcctgggcaagatctggaagctggccgactgcgactgcgacggcatgcttgatgaggaggagttcgcgctggccaagcacctcatcaagatcaagctcgacggctacgagctgcccagcagcctgcccccccacctcgtgcccccctcgcacaggaagtccctgcccaaggccgactgaggggtgggctgcagaacggggtgggaactgggggacctgggcctcaggcctgctccaccactgactcaccgaatgaccttgggcaaggcactgccctctctgtgccttggtttccccatctgtagaatggggagggtggacactggaaactagatgacttctttcacctccaaaattcccttagtttctatgaaaatattgggggtaggggggtggattaggagattgaagggttgagaagaaagagaaattgtccaaagagtcctcagaacctgcctggagaaatgcgcatgggggtgggcctggta

SEQ ID NO: 129327 - DNA, 2235 bp, Homo sapiens
  Payload ID: 5298
  Gene Symbol: ELAC1
  Gene Name: elaC ribonuclease Z 1
  Uniprot ID: Q9H777
  ENST ID: ENST00000269466
  CDS Start-End: 108-1199
ggcgcacttccgcccgggcgcattgtagccccgcggacagctgggccagggtgcgggcctgcgcctccctcggctcctggcgcgggcctcggggagaggggtggaagatgtctatggatgtgacattcctggggacgggtgcagcatacccatctccaacccggggtgcctctgctgtggtccttcggtgtgaaggcgagtgctggctctttgactgtggggagggaacacagacacagcttatgaaaagccaacttaaagcagggagaattaccaagatcttcatcacacaccttcatggagaccatttctttggccttcctgggctcctctgcacaatcagcctgcagagtggctccatggtgtccaaacagcctattgaaatctatggccctgtagggcttcgggactttatctggcgaaccatggaactctctcacacggagctggtcttccattatgtggttcatgaactggttcctacagcagatcaatgtcctgcagaagaactaaaagaatttgcgcatgtgaatagagcagacagtcctcccaaagaggaacaaggaagaactatcctgttagactcagaagaaaactcataccttctgtttgatgatgaacaatttgttgtaaaagcatttcgcctctttcacagaattccctcatttgggttttcagtcgtggaaaagaaacgcccaggtaaactcaatgcacagaaacttaaagaccttggtgttccaccaggtcctgcctatgggaagctgaaaaatggaatttctgttgttctggaaaatggggttacaatttctccccaagatgtcttaaaaaagcctattgttggaagaaaaatctgcatattgggtgactgctctggggttgtgggtgatggaggagtaaaactgtgctttgaagcagacctgttgatccacgaagcaaccctggatgatgcccagatggacaaagcaaaggagcatggccacagcacaccacagatggcagcaacatttgcaaagttgtgccgtgcaaagaggctggttctgactcacttcagtcagaggtacaaaccagttgccttggccagagaaggagaaacagatggcattgcagaactaaaaaagcaagctgaatcagtgttagatctccaagaagtgactctagcagaagattttatggtgataagcattccaatcaagaaatgaaaccagtgttcctgagtgcacactgacatgtctgtgaatatgttactgaacctatagtccagtttttttatttcttgttttagtctgaaattatttgggccctaataatcctaaaaagaatggagctgcattgatgaattggctcagtatttaaagggagcaaactttttgataataaatctttttaagagaaaaaaaacccagcatcctttttgaagtccagatttgtcaaaatgatagactattcagttatacatcttattttgtgctactaccacagatagccaatattccatgcagtcctgggcttagcttctgcccagctttattgctgctattggcaaagagcacaggactcagccctcgtggctaaaaatggtattttggcagtttgtattgaatctgtttgtgttattaacagaagagggagaaatgtcatgagacgttggacaggcaggattgatgatagcatgaccatagctttgctggaatactgaatgcagggtttggctaggtgtttattttaacattttattaaactttctatttgggtcttaacccatggttctcagctggggtgacactgctcctctagaagcaggtttgaaattatgggtatgttttcttgtcacagtgactgagtacggtggtggtagtggtggtactactactactggtatttagtcagcagggataagggatgttagctgtcctgcaaagttttggtcagtcatatacaataaagaatcatctcaccccgaaatgcaaattgcaggcccattgagatacacagcaagttagtttatactcttgatgtgaatatagtttaccaaaattagtgacataatgagtggaattactaggtaagtcaaatcctaaagagtgaatgtgttagaattgcagtgtcataccaaataacattcaaaagaaatgagccattaagtgaagcttatgaacctggaggtaaaaaatgcttatctgttaaactgaggtttcattgacgtgtccctattaataaacgttatttgccccacaa

SEQ ID NO: 129328 - DNA, 975 bp, Homo sapiens
  Payload ID: 5298
  Gene Symbol: ELAC1
  Gene Name: elaC ribonuclease Z 1
  ENST ID: ENST00000591429
  CDS Start-End: 76-747
gcggacagctgggccagggtgcgggcctgcgcctccctcggctcctggcgcgggcctcggggagaggggtggaagatgtctatggatgtgacattcctggggacgggtgcagcatacccatctccaacccggggtgcctctgctgtggtccttcggtgtgaaggcgagtgctggctctttgactgtggggagggaacacagacacagcttatgaaaagccaacttaaagcagggagaattaccaagatcttcatcacacaccttcatggagaccatttctttggccttcctgggctcctctgcacaatcagcctgcagagtggctccatggtgtccaaacagcctattgaaatctatggccctgtagggcttcgggactttatctggcgaaccatggaactctctcacacggagctggtcttccattatgtggttcatgaactggttcctacagcagatcaatgtcctgcagaagaactaaaagaatttgcgcatgtgaatagagcagacagtcctcccaaagaggaacaaggaagaactatcctgttagactcagaagaaaactcataccttctgtttgatgatgaacaatttgttgtaaaagcatttcgcctctttcacagaattccctcatttgggttttcagtcgtggaaaagaaacgcccaggtaaactcaatgcacagaaacttaaagaccttggtaagtgtttttttgttttttgttttttcccgccttctcatcaatagggctcctgttgactgaagctataagaaatgtcatagtaaggccaggagttgtggctcacgcctgtaatcctagcactttgggaggccgaggtgggaggatcacttgagttcgggagttcaagaccagcctgggcaacatggcgaaaccccatctctactaaaaatacaaaaagtaactgggtgtggtgtcatgtgcctgtagtcccagctacttggggggctgaggca

SEQ ID NO: 129329 - DNA, 694 bp, Homo sapiens
  Payload ID: 5298
  Gene Symbol: ELAC1
  Gene Name: elaC ribonuclease Z 1
  ENST ID: ENST00000588577
  CDS Start-End: 133-399
agcggccgcgcgggacccggccggcggcgcacttccgcccgggcgcattgtagccccgcggacagctgggccagggtgcgggcctgcgcctccctcggctcctggcgcgggcctcggggagaggggtggaagatgtctatggatgtgacattcctggggacgggtgcagcatacccatctccaacccggggtgcctctgctgtggtccttcggtgtgaaggcgagtgctggctctttgactgtggggagggaacacagacacagcttatgaaaagccaacttaaagcagaattccctcatttgggttttcagtcgtggaaaagaaacgcccaggtaaactcaatgcacagaaacttaaagaccttggtgttccaccaggtcctgcctatgggaagctgaaaaatggaatttctgttgttctggaaaatggggttacaatttctccccaagatgtcttaaaaaagcctattgttggaagaaaaatctgcatattgggtgactgctctggggttgtgggtgatggaggagtaaaactgtgctttgaagcagacctgttgatccacgaagcaaccctggatgatgcccagatggacaaagcaaaggagcatggccacagcacaccacagatggcagcaacatttgcaaagttgtgccgtgcaaagaggctggttctgactcacttcagtcagaggta

SEQ ID NO: 129330 - DNA, 3148 bp, Homo sapiens
  Payload ID: 5299
  Gene Symbol: ELAC2
  Gene Name: elaC ribonuclease Z 2
  Uniprot ID: Q9BQ52
  ENST ID: ENST00000338034
  CDS Start-End: 241-2721
agaactaggggcggggccgcttgagacgctctagtattcctctactctatggccactgtcaattgacaagtcccgagcggtaaagctcctttctattggatgagcagcctcgcgtaggcgggaagctcggtgcacggcgcgctgattggctggatccgccatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttgggctcccacataagcactagtctatagatgcctcttaggactggtgcctggcacagccgcgggccaggaggctgccacacggaagcaagcagatgaactaatttcatttcaaggcagtttttaaagaagtcttggaaacagacggcggcacctttcctctaatccagcaaagtgattccctgcacaccagagacaagcagagtaacaggatcagtgggtctaagtgtccgagacttaacgaaaatagtatttcagctgcaataaagattgagtttgcaa

SEQ ID NO: 129331 - DNA, 2924 bp, Homo sapiens
  Payload ID: 5299
  Gene Symbol: ELAC2
  Gene Name: elaC ribonuclease Z 2
  ENST ID: ENST00000395962
  CDS Start-End: 75-2498
agcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttgggctcccacataagcactagtctatagatgcctcttaggactggtgcctggcacagccgcgggccaggaggctgccacacggaagcaagcagatgaactaatttcatttcaaggcagtttttaaagaagtcttggaaacagacggcggcacctttcctctaatccagcaaagtgattccctgcacaccagagacaagcagagtaacaggatcagtgggtctaagtgtccgagacttaacgaaaatagtatttcagctgcaataaagattgagtttgca

SEQ ID NO: 129332 - DNA, 2671 bp, Homo sapiens
  Payload ID: 5299
  Gene Symbol: ELAC2
  Gene Name: elaC ribonuclease Z 2
  Uniprot ID: Q9BQ52
  ENST ID: ENST00000426905
  CDS Start-End: 53-2413
aacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttgggctcccacataagcactagtctatagatgcctcttaggactggtgcctggcacagccgcgggccaggaggctgccacacggaagcaagcagatgaactaatttcatttc

SEQ ID NO: 129333 - DNA, 858 bp, Homo sapiens
  Payload ID: 5299
  Gene Symbol: ELAC2
  Gene Name: elaC ribonuclease Z 2
  ENST ID: ENST00000446899
  CDS Start-End: 1-858
tccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagaggttttgcagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataag

SEQ ID NO: 129334 - DNA, 581 bp, Homo sapiens
  Payload ID: 5299
  Gene Symbol: ELAC2
  Gene Name: elaC ribonuclease Z 2
  ENST ID: ENST00000581499
  CDS Start-End: 185-581
atcggggcacctcccagggcttcggcttccctgcttcacacatgtggttcactgttgcgggggttcgtggagttatggtgggtgggaaatccgagattctttgcatccatgtgatttctgcggatctgtgaagaacttcaggcctgggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatg

SEQ ID NO: 129335 - DNA, 579 bp, Homo sapiens
  Payload ID: 5299
  Gene Symbol: ELAC2
  Gene Name: elaC ribonuclease Z 2
  ENST ID: ENST00000580504
  CDS Start-End: 136-579
agtgcggcgcagcctctgagcatcggggcacctcccagggcttcggcttccctgcttcacacatgtggttcactgttgcgggggttcgtggagttatggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgttagccagagaagaggggtcagggactcttccctggtcgtagctttcatctcttcacttaaagagaggaaacttcttggtgctcaaagcaaaggagatgggcctcccagttgggacagctgccatcgctcccatcattgctgctgtcaaggacgggaaaagcat

SEQ ID NO: 129336 - DNA, 2087 bp, Homo sapiens
  Payload ID: 5299
  Gene Symbol: ELAC2
  Gene Name: elaC ribonuclease Z 2
  ENST ID: ENST00000584650
  CDS Start-End: 1-1880
aaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttgggctcccacataagcactagtctatagatgcctcttaggactggtgcctggcacagccg

SEQ ID NO: 129337 - DNA, 428 bp, Homo sapiens
  Payload ID: 5299
  Gene Symbol: ELAC2
  Gene Name: elaC ribonuclease Z 2
  ENST ID: ENST00000476042
  CDS Start-End: 1-137
cccccgtggccttggtggttcacatggccccagcatctgtgcttgtggacagcaggtaccagcagtggatggagaggtatggagcccagcccagcggcacttggggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgc

SEQ ID NO: 129338 - DNA, 479 bp, Homo sapiens
  Payload ID: 5299
  Gene Symbol: ELAC2
  Gene Name: elaC ribonuclease Z 2
  ENST ID: ENST00000583371
  CDS Start-End: 113-479
aagctcggtgcacggcgcgctgattggctggatccgccatgcggagcggctaggtggtgcacgggaaacgcgggcgtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagt

SEQ ID NO: 129339 - DNA, 866 bp, Homo sapiens
  Payload ID: 5299
  Gene Symbol: ELAC2
  Gene Name: elaC ribonuclease Z 2
  ENST ID: ENST00000609101
  CDS Start-End: 140-866
cccgtcccgctgggccctcagtgcggcgcagcctctgagcatcggggcacctcccagggcttcggcttccctgcttcacacatgtggttcactgttgcgggggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccg

SEQ ID NO: 129340 - DNA, 588 bp, Homo sapiens
  Payload ID: 5299
  Gene Symbol: ELAC2
  Gene Name: elaC ribonuclease Z 2
  ENST ID: ENST00000609757
  CDS Start-End: 216-588
gttgcgggggttcgtggagttatggtgggtgggaaatccgagattctttgcatccatgtgatttctgcggatctgtgaagaacttcaggcctgggtctgagcgtccttttcccaacccttgggccccggcctggctgtcagcactttcggagctccaccctcttccgtgcaccccaaggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatg

SEQ ID NO: 129341 - DNA, 579 bp, Homo sapiens
  Payload ID: 5299
  Gene Symbol: ELAC2
  Gene Name: elaC ribonuclease Z 2
  ENST ID: ENST00000578071
  CDS Start-End: 20-496
ttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactgctgtgcggccccactctgccccagaatacgaggatgaaaccatgacagtttaccagatccccatacacagtgaacagaggaggggaaagcaccaaccatggcagagtccagaaaggcctctcagcagg

SEQ ID NO: 129342 - DNA, 920 bp, Homo sapiens
  Payload ID: 5300
  Gene Symbol: ELANE
  Gene Name: elastase, neutrophil expressed
  Uniprot ID: P08246
  ENST ID: ENST00000263621
  CDS Start-End: 39-842
gcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgt

SEQ ID NO: 129343 - DNA, 1028 bp, Homo sapiens
  Payload ID: 5300
  Gene Symbol: ELANE
  Gene Name: elastase, neutrophil expressed
  Uniprot ID: P08246
  ENST ID: ENST00000590230
  CDS Start-End: 142-945
tgaccgtgagcctgggtgaaagggagaggaagtggagggcgctggccggccgtggggcaatgcaacggcctcccagcacagggctataagaggagccgggcgggcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgtagaat

SEQ ID NO: 129344 - DNA, 920 bp, Homo sapiens; identical to SEQ ID NO: 129342
  Payload ID: 5300
  Gene Symbol: ELANE
  Gene Name: elastase, neutrophil expressed
  Uniprot ID: P08246
  ENST ID: ENST00000615489
  CDS Start-End: 39-842

SEQ ID NO: 129345 - DNA, 1028 bp, Homo sapiens; identical to SEQ ID NO: 129343
  Payload ID: 5300
  Gene Symbol: ELANE
  Gene Name: elastase, neutrophil expressed
  Uniprot ID: P08246
  ENST ID: ENST00000632488
  CDS Start-End: 142-945

SEQ ID NO: 129346 - DNA, 3781 bp, Homo sapiens
  Payload ID: 5301
  Gene Symbol: ELN
  Gene Name: elastin
  Uniprot ID: P15502
  ENST ID: ENST00000252034
  CDS Start-End: 400-2574
cctcccttctgcttcctctcccgagggctgtcctggcagaggcccccctcgctctttctggcgggaacagggccagcagcgaaagaacagtcgcagagggaaagcgggaaagagatgggggaaagtgtgtgtgtgtgagtgtgtgcttgtgtgcatgtgtgtgcgtgtgtgtgtcaaggaaaaaagctcgcagtccagcagcccgggcctgggaggcttgtgagccgggcctttcgtaattgtcccctccccgcggccccctcccccaggcctcccccctctcccgccctcccgcccgccctctctccctccctctttccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaa

SEQ ID NO: 129347 - DNA, 2274 bp, Homo sapiens
  Payload ID: 5301
  Gene Symbol: ELN
  Gene Name: elastin
  Uniprot ID: P15502
  ENST ID: ENST00000320399
  CDS Start-End: 1-2274
atggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcaggtgcagatgagggagttaggcggagcctgtcccctgagctcagggaaggagatccctcctcctctcagcacctccccagcaccccctcatcacccagggtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 129348 - DNA, 2991 bp, Homo sapiens
  Payload ID: 5301
  Gene Symbol: ELN
  Gene Name: elastin
  ENST ID: ENST00000320492
  CDS Start-End: 83-2014
tccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggagttggaccctttgggggaccgcaacctggagtcccactggggtatcccatcaaggcccccaagctgcctggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggagccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgg

SEQ ID NO: 129349 - DNA, 3361 bp, Homo sapiens
  Payload ID: 5301
  Gene Symbol: ELN
  Gene Name: elastin
  Uniprot ID: P15502
  ENST ID: ENST00000357036
  CDS Start-End: 19-2154
ggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcagccccttctgtgccaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaa

SEQ ID NO: 129350 - DNA, 3967 bp, Homo sapiens
  Payload ID: 5301
  Gene Symbol: ELN
  Gene Name: elastin
  ENST ID: ENST00000358929
  CDS Start-End: 400-2760
cctcccttctgcttcctctcccgagggctgtcctggcagaggcccccctcgctctttctggcgggaacagggccagcagcgaaagaacagtcgcagagggaaagcgggaaagagatgggggaaagtgtgtgtgtgtgagtgtgtgcttgtgtgcatgtgtgtgcgtgtgtgtgtcaaggaaaaaagctcgcagtccagcagcccgggcctgggaggcttgtgagccgggcctttcgtaattgtcccctccccgcggccccctcccccaggcctcccccctctcccgccctcccgcccgccctctctccctccctctttccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggtgctgcaggagcaggagtgctgggtgggctagtgccaggtgccccaggcgcagtcccaggtgtgccgggcacgggaggagtgccaggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcaggtgcagatgagggagttaggcggagcctgtcccctgagctcagggaaggagatccctcctcctctcagcacctccccagcaccccctcatcacccagggtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaa

SEQ ID NO: 129351 - DNA, 2703 bp, Homo sapiens
  Payload ID: 5301
  Gene Symbol: ELN
  Gene Name: elastin
  Uniprot ID: P15502
  ENST ID: ENST00000380553
  CDS Start-End: 14-1726
atttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcaggtgtaggtggagcttttgctggaatcccaggagttggaccctttgggggaccgcaacctggagtcccactggggtatcccatcaaggcccccaagctgcctggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgg

SEQ ID NO: 129352 - DNA, 2240 bp, Homo sapiens
  Payload ID: 5301
  Gene Symbol: ELN
  Gene Name: elastin
  Uniprot ID: P15502
  ENST ID: ENST00000380562
  CDS Start-End: 48-2240
gggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 129353 - DNA, 3043 bp, Homo sapiens
  Payload ID: 5301
  Gene Symbol: ELN
  Gene Name: elastin
  Uniprot ID: P15502
  ENST ID: ENST00000380575
  CDS Start-End: 32-2065
cggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgga

SEQ ID NO: 129354 - DNA, 3109 bp, Homo sapiens
  Payload ID: 5301
  Gene Symbol: ELN
  Gene Name: elastin
  Uniprot ID: P15502
  ENST ID: ENST00000380576
  CDS Start-End: 14-2131
atttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgga

SEQ ID NO: 129355 - DNA, 3214 bp, Homo sapiens
  Payload ID: 5301
  Gene Symbol: ELN
  Gene Name: elastin
  Uniprot ID: P15502
  ENST ID: ENST00000380584
  CDS Start-End: 31-2007
ggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcaggagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaa

SEQ ID NO: 129356 - DNA, 563 bp, Homo sapiens
  Payload ID: 5301
  Gene Symbol: ELN
  Gene Name: elastin
  ENST ID: ENST00000438880
  CDS Start-End: 60-563
aattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccaggagttggaccctttgggggaccgcaacctggagtcccactggggtatcccatcaaggcccccaagctgcctggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgca

SEQ ID NO: 129357 - DNA, 2583 bp, Homo sapiens
  Payload ID: 5301
  Gene Symbol: ELN
  Gene Name: elastin
  ENST ID: ENST00000445912
  CDS Start-End: 400-2520
cctcccttctgcttcctctcccgagggctgtcctggcagaggcccccctcgctctttctggcgggaacagggccagcagcgaaagaacagtcgcagagggaaagcgggaaagagatgggggaaagtgtgtgtgtgtgagtgtgtgcttgtgtgcatgtgtgtgcgtgtgtgtgtcaaggaaaaaagctcgcagtccagcagcccgggcctgggaggcttgtgagccgggcctttcgtaattgtcccctccccgcggccccctcccccaggcctcccccctctcccgccctcccgcccgccctctctccctccctctttccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgt

SEQ ID NO: 129358 - DNA, 3298 bp, Homo sapiens
  Payload ID: 5301
  Gene Symbol: ELN
  Gene Name: elastin
  Uniprot ID: P15502
  ENST ID: ENST00000429192
  CDS Start-End: 16-2094
gcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcagccccttctgtgccaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaagg

SEQ ID NO: 129359 - DNA, 3139 bp, Homo sapiens
  Payload ID: 5301
  Gene Symbol: ELN
  Gene Name: elastin
  ENST ID: ENST00000414324
  CDS Start-End: 60-2162
aattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcagccccttctgtgccaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgg

SEQ ID NO: 129360 - DNA, 542 bp, Homo sapiens
  Payload ID: 5301
  Gene Symbol: ELN
  Gene Name: elastin
  ENST ID: ENST00000431562
  CDS Start-End: 88-542
ctctttccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcagg

SEQ ID NO: 129361 - DNA, 512 bp, Homo sapiens
  Payload ID: 5301
  Gene Symbol: ELN
  Gene Name: elastin
  ENST ID: ENST00000428787
  CDS Start-End: 13-512
tttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacagg

SEQ ID NO: 129362 - DNA, 3147 bp, Homo sapiens
  Payload ID: 5301
  Gene Symbol: ELN
  Gene Name: elastin
  ENST ID: ENST00000458204
  CDS Start-End: 26-2170
gcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgg

SEQ ID NO: 129363 - DNA, 542 bp, Homo sapiens
  Payload ID: 5301
  Gene Symbol: ELN
  Gene Name: elastin
  ENST ID: ENST00000442310
  CDS Start-End: 14-542
atttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtaggtggagcttttgctggaatcccaggagttggaccctttgggggaccgcaacctggagtcccactggggtatcccatcaaggcccccaagctgcctg

SEQ ID NO: 129364 - DNA, 714 bp, Homo sapiens
  Payload ID: 5301
  Gene Symbol: ELN
  Gene Name: elastin
  ENST ID: ENST00000416107
  CDS Start-End: 14-220
atttctccccgagatggcgggtctgacggcggcggccccgcggcccggagtcctcctgctcctgctgtccatcctccacccctctcggcctggaggggtccctggggccattcctggtggagttcctggaggagtcttttatccaggtaacgtacatgaaacttccacacacccaggtcatgcggatgatgctgatgtccataatagatgcacattttgacactacagaaggtaggaacattgacacgcctaccagaagtcacacccacttaaaaatgcaattaacaagacattgatttacagctattaagagcatacaggctggacatggtggcttatgcctgtaatctcaacactctgggaggcagagaaacaaggattgcttgaggccaggagtttcagaccagcctggacaacatagggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgg

SEQ ID NO: 129365 - DNA, 962 bp, Homo sapiens
  Payload ID: 5301
  Gene Symbol: ELN
  Gene Name: elastin
  ENST ID: ENST00000438906
  CDS Start-End: 80-962
ctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatg

SEQ ID NO: 129366 - DNA, 658 bp, Homo sapiens
  Payload ID: 5301
  Gene Symbol: ELN
  Gene Name: elastin
  ENST ID: ENST00000417091
  CDS Start-End: 16-658
gcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacag

SEQ ID NO: 129367 - DNA, 489 bp, Homo sapiens
  Payload ID: 5301
  Gene Symbol: ELN
  Gene Name: elastin
  ENST ID: ENST00000419398
  CDS Start-End: 1-183
gttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccggccctttaggaagtgacttcaggttaaacaaaagactgcctgagtctacgcagcagggagggacatctggaagctgttagccagaggtgggctggcccagccatgtaaacaggctccaggagacggagataaatccacacaccgaagagtttgcagatgacttccgaaactcgtgggaggagggttgtggccaccccacgtctgtccctggctgcccctgtcgggcacagaggctgtgtggggctgccaggtgtatacccaggtggcgtgctcccaggagctcggttccccggtgtgggggtgctccctggagtt

SEQ ID NO: 129368 - DNA, 3452 bp, Homo sapiens
  Payload ID: 5301
  Gene Symbol: ELN
  Gene Name: elastin
  ENST ID: ENST00000621115
  CDS Start-End: 400-2253
cctcccttctgcttcctctcccgagggctgtcctggcagaggcccccctcgctctttctggcgggaacagggccagcagcgaaagaacagtcgcagagggaaagcgggaaagagatgggggaaagtgtgtgtgtgtgagtgtgtgcttgtgtgcatgtgtgtgcgtgtgtgtgtcaaggaaaaaagctcgcagtccagcagcccgggcctgggaggcttgtgagccgggcctttcgtaattgtcccctccccgcggccccctcccccaggcctcccccctctcccgccctcccgcccgccctctctccctccctctttccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggagccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaaccttt

SEQ ID NO: 129369 - DNA, 3943 bp, Homo sapiens
  Payload ID: 5302
  Gene Symbol: EMILIN1
  Gene Name: elastin microfibril interfacer 1
  ENST ID: ENST00000380320
  CDS Start-End: 500-3550
gggaggggagccagcagggaggaggaggccagggcccgccccacagccactctcgcgcctccgaacagccacaggggcaaagccctgtcacccccaggatccggtcatcagggaaagaggacagggagaccagaagagggccagctgggacgagggggcggacgcccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtccccaaagcatcatgtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccggcctgcccgccccaacctctctggctccagtgcaggcagccccctcagtggactggggggagaaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgaccaggagctgggtcacctcaacaaccatcatggcggcagcagcagcagtgggggcagcagggccccagccccagcctcagcccctccgggccccagtgaggagctgctgcggcagctggagcagcggttgcaggagtcctgctccgtgtgcctggccgggctagatggcttccgccggcagcagcaggaggacagggagcggctgcgagcgatggagaagctgctggcctcggtggaggagcggcaacggcacctcgcagggctggcggtgggccgcaggccccctcaggaatgctgctctccagagctgggccggcgactggcagagctggagcgcaggctggatgtcgtggccggctcagtgacagtgctgagtgggcggcgaggcacagagctgggaggagccgcggggcagggaggccaccccccaggctacaccagcttggcctcccgcctgtctcgcctggaggaccgcttcaactccaccctgggcccttcggaggagcaggaggagagctggcctggggctcctggggggctgagccactggctgcctgctgcccggggccgactagagcagttgggggggctgctggccaatgtgagcggggagctgggggggcggttggatctgttggaggagcaggtggcaggggccatgcaggcatgcgggcagctctgctctggggcccctggggagcaggactctcaagtcagcgagatcctcagtgccttggagcgcagggtgctggacagtgaggggcagctgcggctggtgggctccggcctgcacacggtggaagcagcgggggaggcccggcaggccacgctggagggattacaagaggttgtgggccggctccaggatcgtgtggatgcccaggatgagacagctgcagagttcacactacggctgaatctcactgcggcccggctaggccaactggaggggctgctgcaggcccatggggatgagggctgtggggcctgtggcggagtccaagaggaactaggccgccttcgggatggtgtggagcgctgctcctgccccctgttgcctcctcggggtcctggggctggtccaggtgttgggggcccaagccgtgggcccctggacggcttcagcgtgtttgggggcagctcaggctcagccctgcaggccctgcaaggagagctctctgaggttattctcagcttcagctccctcaatgactcactgaatgagctccagaccactgtggagggccagggcgctgatctggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactgggcctgcaggagaggctgggcccccagggcctcctgggctgcagggacccccaggccctgctggacctccaggatcaccaggcaaggacgggcaagagggccccatcgggccaccaggtcctcaaggtgaacagggagtggagggggcaccagcagcccctgtgccccaagtggcattttcagctgctctgagtttgccccggtctgaaccaggcacggtccccttcgacagagtcctgctcaatgatggaggctattatgatccagagacaggcgtgttcacagcgccactggctggacgctacttgctgagcgcggtgctgactgggcaccggcacgagaaagtggaggccgtgctgtcccgctccaaccagggcgtggcccgcgtagactccggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttctaaaaaaaactaaa

SEQ ID NO: 129370 - DNA, 1431 bp, Homo sapiens
  Payload ID: 5302
  Gene Symbol: EMILIN1
  Gene Name: elastin microfibril interfacer 1
  ENST ID: ENST00000433140
  CDS Start-End: 1-1043
tggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactggtgaggggacaaaagggcctgcaggagaggctgggcccccagggcctcctgggctgcagggacccccaggccctgctggacctccaggatcaccaggcaaggacgggcaagagggccccatcgggccaccaggtcctcaaggtgaacagggagtggagggggcaccagcagcccctgtgccccaagtggcattttcagctgctctgagtttgccccggtctgaaccaggcacggtccccttcgacagagtcctgctcaatgatggaggctattatgatccagagacaggcgtgttcacagcgccactggctggacgctacttgctgagcgcggtgctgactgggcaccggcacgagaaagtggaggccgtgctgtcccgctccaaccagggcgtggcccgcgtagactccggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttctaaaaaaaa

SEQ ID NO: 129371 - DNA, 5910 bp, Homo sapiens
  Payload ID: 5303
  Gene Symbol: EMILIN2
  Gene Name: elastin microfibril interfacer 2
  Uniprot ID: Q9BXX0
  ENST ID: ENST00000254528
  CDS Start-End: 160-3321
ccggagggggcggccgcggagcactggttggagcgccgcgaagcgcccgagcctcttgccttcgcgggcggcgccctggccgccggcagccttgtggccggtgccccgatccgccgcgctccggacccgggcaggcggggcgcgcccgctgcgcgcgggatgtggcagcccagacggccctggccccgcgtgccctggcgctgggcgctggcgctgctggccctggttggcgcggggctgtgccacgccggcccgcagcccgggtatcccgcgcggcccagcgccaggaacaagaactggtgcgcctacatcgtgaacaagaatgtgagctgctccgtgctggagggaagtgagagttttattcaggctcagtacaactgtgcctggaaccagatgccctgtccgtcggcgctggtgtatcgagtgaacttcagacctagatatgtcactaggtataagacagtgacacagttggaatggaggtgctgtcctggctttagagggggagattgccaagaaggtcccaaagaccccgtgaagaccctccgccccacgccggctcggcctcgaaacagcttgaagaaagccacagataatgaacccagccaattctcagagcccaggaagactttgtccccaactggtacagcacaaccaagctggggggtagatccaaaagaggggcctcaggaacttcaggaaaagaagatacaggtgctagaggagaaggttcttcgactcacaaggacggttcttgacctccagtcttcccttgctggagtgagtgaaaatctcaaacatgccactcaggatgatgccagtagaacacgggcaccagggctcagcagccagcaccccaagcctgacaccactgttagtggagacacagaaacgggccagagtcctggtgtcttcaacactaaggaatctggcatgaaggacatcaagtctgaattggctgaagtcaaagatactctaaagaacaaaagtgacaagctggaagagctggatggaaaagtgaagggctacgaagggcagctcagacagctccaggaagcagctcagggcccgacggtgaccatgacaaccaacgaactctaccaagcctatgtggacagtaagatcgacgccctgagagaggagctcatggagggcatggacagaaagctggctgacctgaaaaactcatgtgagtacaagctcactggcctccagcagcagtgtgatgactatgggagcagctacctgggagtgatagagctcataggggagaaggaaacaagcctgagaaaagaaataaataacctccgagcccggctacaggagccttcagcccaggcaaattgctgcgacagtgaaaagaatggtgacattggtcaacagatcaagacattggaccagaaaatcgagagagttgctgaagccaccagaatgctgaatggaagactggacaatgagtttgaccgccttatagttccagagccagatgtggattttgatgcaaaatggaatgaactcgatgcaaggatcaatgtgacggagaagaacgctgaagaacattgcttttacattgaggaaacccttcggggcgccattaatggagaggtgggtgacttgaagcagcttgttgatcagaaaatacagtctctggaagaccgtctggggagcgttctcctacagatgaccaataacactggtgcagagctcagtcccccaggggcagcagccctgccaggagtgtcagggtcaggagatgaacgggtcatgatggaattaaaccacctgaaggacaaagttcaagttgttgaagacatttgcctgctgaacatccagggaaagcctcatgggatggaaggtgccttgccaaacagggaagaccgcgcagtacgcgacagcctgcaccttttgaaatctctcaacgacacgatgcacaggaagtttcaagaaaccgaacaaaccatccagaaacttcaacaggattttagttttctttattctcaattaaaccacacagaaaatgatgtgactcatcttcaaaaggaaatgagcaattgtagagcaggtgaaaacgctggcatgggtaggttcactaaggtgggtgagcaagaaaggacagtggacaccctgccgtccccccagcaccccgtggctcattgctgcagtcagctggaggagaggtggcagaggttgcagagccaggtcatctcggagctggatgcttgtaaggaatgcacgcagggggtccagagggaggtctccatggtggagggcagggtgtctcatatggagaaaacttgcagcaagctggactctatctcaggaaatcttcagaggatcaaggaggggctcaacaagcatgtcagcagcctgtggaactgtgtcaggcagatgaacggaacgctcaggtcgcattccagagacatttctggcctgaagaattcagtccagcagttctacagccacgtcttccagatttctactgatttgcaagatctggtcaaatttcagccatcagcaaaggcgccctcgcccccgccgcccgcagaggccccgaaggagccgctgcagcccgagcccgccccgccgaggcccagcggccccgcaaccgcagaggaccctgggcgacggcccgtcctgccccagcggccccccgaggagaggccgccccagccgccaggctccaccggggtcatcgcggagacgggccaggccgggccccccgcaggcgcaggcgtgtctgggcggggtctgccgcggggcgtggacggccagaccgggagcggcaccgtccccggcgcagaaggcttcgcgggcgcaccaggatacccgaagtcacctcctgtagcttccccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctccaacgccagcgtggcccagctgcataccgctgggtacaggagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaaggtggctggggagatgtcaggggaaagatagatagttgtaaaaactctaaagctttaatatattcggtttgtatgtaatggaagcacggggctagagtttccacataggccccaacataaaggccttccctcgctgttgaggccaccatgccttactgcatccagccaggctgcagggagtgaggcacacggtgaacatggccactgacttttctgccactctaactggacaactggaagacttggaaaggcctccacctgtatctacactctgagggccctggactgggcctgagcttgccacagaggctccgtctgactgtgggctgggaggagggaggcaggggagagccggtcacggtggctggtctttactgcagggcagcactgtggccagctgtctgtctttacactgcatgcagaagtttaaacactgaagtgccgaagtggcccgtgccgccgcacagagaccccgactttagtttgggctgttccacgcttggctcaccattgccgcctgggacttaacctgctcaggcgggccttcgcccagctgcaaatagggatgcgttagagactgttcccaaagcttgttgggctccttaaatggcatgtacaatttaagtgcaaagacagggagtgtcaataaagatggaaagccatttccagttaacttttgttaatttaagtgtggtcccttacagatcgggagttgttgctaaaaagcaaactgaagaaatgttttgtttcaaaaagggctacagaaagtaaccttgagtaaaattaatctcagctacaaaactgttacccctccgcatccaagctatacacttgggttttgtttctggcttgtgaagacggaccagatgtgcacggaggtcaaggccccatgtcatctgcagctggagcggctcctctggggatgctgcactcagatcccacagcagctgcccaggctaacttgatccctgctgcttcactgcaccaatctccagcagacacagctcgccgagctcttgggtttctaagcagcaggaagctcaacctaacgctggccacacgctgacagctgagcccatctgagaacacggcatcttcacacagcgagacgcctccactgaggggaggcccgggagtatcaatctgtcaccagtggccacggagacctctcagcacccttagttcaaggtagtctctgtggatcaggttggtaacacctactggttaatcaagtcccactggggaaaggtttggacggtagaatcaagagctgcagtttccttggcccacaagatgctcttatgctgtaaaaaaaatgctttaagaattgtttgcaaatgaatttacagggtggccactggacacttcagagttccttatttactccccccgccacagctaggaagaccagcaagaactaaaggtttgccgttttactatttaaaatgtggacctctttgtccaggagcgggagggagaatggcatctcaccccattacaacagctggggaactggctaaagagagctgtcagagagtatccttggctgtcctaggaatgactcatggaaagcgccccagtgcagcagtgttttcaggaaaacccagtgggcacgcgccatcgccctctcctctcctctcacgctccttttgaaaagaccgcactcggcgcccaaggggacgtgctcaagagctgcaggggcagggcccaggcaaaaggtgggtgatgactacctgctgctttccctactccgtagatgggtctggaacatcgggtaaaacccagtcctcctctcagtgcatctctactcaccaacaatggtgaatctcagctctgtgtattcaagacaggcaaaacagaatatgcctcattatggctggagcgtgcctctactttgagataaagctggatgacaggtggatcctggcccacttaggagacatctttagaaagggaaaggctgtctttttgtacaggtagtagaacaacaaggtcagctgagcttaaggctgtggggttcgaagcagcccttcaagaagtcatcacccctgaagtagtgcctgcgagtcagtcagaggcataccaaaccctgagacagaatcaggcacaagttcacaacttttttttttttttggggggagacagtcctactctgtcgcccaggctggagtgcagtagcgcgatctcagctcactgcaacctccgcctcccgggttcaagcaattctcctacctcagcctcccgagtagcggggactacaggtgcatgccgccacgcccggttaattttttgtattttagtagagatggggtttcaccgtgttgcccaggctggtcgcgaactcctgagctcagccaatccgcccacctcggcctcccaaagtgctgggattacaggtatgagccaccacgcccagccaagttcacaacttctgatatcaagttgttgctgagaaaaggtcaggacacttcttaagtagagaaggactgtgacatcccctccaaacctccatgtaacactaacaaatggcctcatttacacgattaaaaacaaaatggtatcgtcaataaatgcaaaccttaaactgca

SEQ ID NO: 129372 - DNA, 3796 bp, Homo sapiens
  Payload ID: 5304
  Gene Symbol: EMILIN3
  Gene Name: elastin microfibril interfacer 3
  Uniprot ID: Q9NT22
  ENST ID: ENST00000332312
  CDS Start-End: 194-2494
gcgccggccactccgcgggacgcagccgccgcgaagcgccaggcggccgggccagcgagctcgggggccgaaggggaccccgggaccctcggggcgggacccgggccgaccagcggcgggggcggcgcggcgctgcaggcggacacccggcggggggcaccgcgcggggccgggcagaggcgcgggggccgctatgggccgccgccgcctgctcgtctggctgtgcgccgtcgcggcgctgctctcgggggcgcaggccaggggcaccccgctcctggcgcggcctgcgccgcccggtgcctcccgctacagtctctacacgacgggatggcgcccgcggctgcgcccggggccgcacaaggccctctgtgcctatgtggtgcacaggaatgtgacctgcatcctacaggagggagcggagagctacgtaaaggctgaataccggcagtgtagatgggggcccaagtgccccgggacagtcacgtaccgcacagtactcagacccaaatacaaggttggctacaagacagtgacagacctcgcctggcgttgctgtcccggcttcactgggaaacgctgccctgagcacctcacggaccatggggctgcctcaccccagctggagcctgagcctcagattccttcagggcagctggacccaggccccaggcccccttcctacagcagagcagcccccagccctcatggaaggaaaggcccagggctgtttggtgagcggctggaacgcctggagggtgatgtccagcgcctggctcaaacatatggtaccctcagtggcctggtggctagccacgaggatcccaacaggatgactggtggccccagggctcctgctgtccctgtgggctttggggtcatccctgaggggcttgtgggcccaggagacagagccagagggccactaacacctcccttagacgagatcctaagcaaggtgacagaggtgagcaacactcttcagaccaaggtgcagcttctagacaaggtgcatgggctggcacttggccatgaggcccacctgcagcggctgcgggaagccccaccatccccgctcacctccctggccctgctggaggagtacgtggaccgacggctgcaccgactctgggggagcctgctggatggctttgagcagaagctgcaaggcgtccagagtgagtgtgacctgcgggtgcaggaggtacggcggcaatgtgaggagggtcaggccgccagccggaggctgcaccagagccttgatggccgggagctggccctgcgccaggagctgtcacagctgggcagccagctgcagggcctgagcgtgtctggcaggggcagctgctgtgggcaactagccttgatcaatgcccgtatggatggccttgagagggccctgcaggcagtcaccgagacccaaaggggccccggtgccccggccggggatgagcttacgaggctctctgctgccatgctcgagggaggtgtggacgggctgcttgagggtctggagacgctcaatgggacagagggtggagcaaggggatgctgtctgaggttggacatgggggggtggggagtgggcggctttgggaccatgctggaagagcgcgtgcagagcctcgaggagcgcctagcaacattggctggggagctaagccatgacagcgcctctccgggcaggtcagctcggccccttgtacagacagagctggctgtgctagagcaacggttggtctcactggagacttcgtgcaccccgagcaccacctcagccatcctggacagcctcgtggcagaggtgaaggcctggcagagccggagcgaggccctcctacgccaggtggccagccacgcagcactgctccagcagctcaatggcactgtggccgaggtccagggacagctggcagaagggacgggcagctcacttcaaggcgagatcactctgctcaaggtcaatctgaactcagtgagcaagtcgctcacaggcctcagtgactctgtcagccagtactctgatgccttcttggctgccaacacgtccctggatgagcgggaacgcaaggtggaagccgaagtccaggccatccaggagcaggtcagcagccaaggctccaggcttcaggctggccacaggcaggtcctgaacctgcgtggggagctggagcaactcaaggctggtgtggccaaggtggccagtgggctgagccgctgccaggacacagcccagaaacttcagcacacagtgggacactttgaccagcgggtggcacaagtggagggtgcgtgcaggaggctgggcctgctggccgcgggcctggacagcttgcccactgagccactgaggcccagagagggcctgtggagccatgtggaccagctgaatcgtacgctggcccagcacacgcaggacattgcccgcctccgggatgacctactggactgccaggcccagctggctgagcaggtgcggccagggcaagccaactagacaggctggccaggacccaacccctagatcccaccaactcggggaacatcaccccagagcccagccttatccagcagcgccttccagccttccctggctagcccaaatggcactaaggaggccactgagggaatcctccacgtggctgtcccagccaccaaaacccatgcacagtgctgcagaaactggacagttccggacagcggtcaaggcaaggatgtcatgcttgaaggccagggtagacttgagagagttcacattccactgtcagcaaatcagtgtctggacagccagctgcagggcctgagcatggctggcaggggcagctgctgtggcaaactggccttgatcagtgtccgtatgtaaggccttgagaggaccctgcaggcagtcagcaccagcctcagcaactgtgcagagacctacaggcccacagccagtggcctgtccgcattgccctgtgcccacaagcaacagtccacagcccttggtggcttctgttccttgtcccctcggcttctcttcgcagccatcaggactaggtttgtgcaggaaggtgatgcccactggaactctcctcacacctggcagcttcatggatgttgtatctgaactaaggaccagaggctgccagatgtttctggctcctcacgtgtccttcaggacagaacagaagcacaaagactcagccaagagttctctttattccctttgatcctcccccaaggtgagggcttaggcagctgtagaaccccaggaaagaacggaatccaggcaatctgtttagagaccccccactccaaatttatccttttcctttccttcccctaagatgtttccagggccctctggtgcccacactgtcctcttccttccacttgggggtggggaaatccttcctgcgaggtcagggcatttctctacaaagtggcctgaatgaggccaggccctgagaaggagccaccagctggaggaaaggggctccaagccttgcttttaacacccctgcaaaacccccaccctcccaagatgttcacaaaaggtgagaaattcaggtacgaaaccatcaatggacaacttgaaaatgcatgttcctcaggcctatgcagttcccagagactcttgacaccggtctctgctgaggctcccagcctcagtttcccccacagcagcacgggccccactgtgctgctcttcaggtccccacagccctgcctttggttcctggacatttggtattctgccctccactctggtactatcagagtagggcaggctctggattaaagcttttagccggtc

SEQ ID NO: 129373 - DNA, 3763 bp, Homo sapiens
  Payload ID: 5305
  Gene Symbol: ELAVL2
  Gene Name: ELAV like neuron-specific RNA binding protein 2
  Uniprot ID: Q12926
  ENST ID: ENST00000223951
  CDS Start-End: 270-1310
agtccgaactctgggcgggaacactggtgggggcggcggaggttgtgcccgcgaagttcctagagctcagcccgttgcggcgggagtagagagaattgggcgcctcgggaggtggcaccgcccctcccgtgggcacaagcaggttgggggcggcgggagccgagcggggacagtcgcgcctggcagcgtgcacgggcgtggacgtgcccgggtgcggccgcgtgtagcgcaagaaggaaactgttgagacgcagcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcatatgacacctagtgagcttttaaaatttaccaggaaatttgcagcggttggaaaatttagaaagatttatggtgtagaaaatacttttgagatctttgtatgaaaggagtagaatcaatggggggaaacactgctggtttcatttttgtaatcaccagtggagcgtctgatcatcctggttattatgtgataggtggctcacattgatttgtgattttgaaacaaataaaaaaaatttacaaaagaatatataagagcaggcaagaaatttaaattaccgagagatgggggaaaaaatctgttcttcctaaagaaatcccttcagatagagctcatggtgtttagtgatgtacttgcagtattgtttgaagaattgttttgtcttaaggaaaaaagacgttgcacatgatttgtactgcagcaaatcagcaaaagtgatctgagttggatatatttgaaggtattttgaaagttacgttcaaggctaacacctgagctttgtgtaatgtaaataagaccttgtgtttatgaacctttcagctaatttaattttttttcccttacatgccaagtgatgttcaggttttgaatgtttttgtatcagttttttcctttgtaaatggcattaacattgttacttgaggtcttgcttaatcacttttgttgtcctgaggacttgaatttacagtgcatcagatttgttgcaaattttgtctgtagatagtctagcttcagctgtttatggtgatgctacattttggtttataaatatgtttgtggtataaaaaaatgagtataaccataggttttgaacaaatttccttacatttttcatacaaaaatcataaatatctgtatgctattgaaatttaactttgtatgatgcttaaaaaccactatttggggaaataataaaataagtctttaccatgtatgaaagaaattttaaaaaatacaaaatattttctgattagcatctagcttataataaattttcaaaaaagctgaaggcaaaaatgccttcatcaggatgcactgagaactatatagttacgtcctgctttttgtataaactgagatgctcacatgcttccccttagaacaggcaatgtgctatgcataacatagttgtacattatctttgcggttgctttgagttttattttttattatttaaaattgtagttataaaatttttcagtatagtacagtacatatactgtgaggcgcgtgctaaagtgaataagcgagttttcatgctgacccactcaatgctattcagaaatcaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtttggattctttgtactttttcatgttcagtacatcaataaacaaagttgaagggaaa

SEQ ID NO: 129374 - DNA, 3691 bp, Homo sapiens
  Payload ID: 5305
  Gene Symbol: ELAVL2
  Gene Name: ELAV like neuron-specific RNA binding protein 2
  ENST ID: ENST00000380110
  CDS Start-End: 69-1238
gcccgggtgcggccgcgtgtagcgcaagaaggaaactgttgagacgcagacggcaactccaaactaacatggcagtcagactgtgtgatgtggcttctctgcttagaagtggttcgtgggcagcagagccttggaccgggcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagagcaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcatatgacacctagtgagcttttaaaatttaccaggaaatttgcagcggttggaaaatttagaaagatttatggtgtagaaaatacttttgagatctttgtatgaaaggagtagaatcaatggggggaaacactgctggtttcatttttgtaatcaccagtggagcgtctgatcatcctggttattatgtgataggtggctcacattgatttgtgattttgaaacaaataaaaaaaatttacaaaagaatatataagagcaggcaagaaatttaaattaccgagagatgggggaaaaaatctgttcttcctaaagaaatcccttcagatagagctcatggtgtttagtgatgtacttgcagtattgtttgaagaattgttttgtcttaaggaaaaaagacgttgcacatgatttgtactgcagcaaatcagcaaaagtgatctgagttggatatatttgaaggtattttgaaagttacgttcaaggctaacacctgagctttgtgtaatgtaaataagaccttgtgtttatgaacctttcagctaatttaattttttttcccttacatgccaagtgatgttcaggttttgaatgtttttgtatcagttttttcctttgtaaatggcattaacattgttacttgaggtcttgcttaatcacttttgttgtcctgaggacttgaatttacagtgcatcagatttgttgcaaattttgtctgtagatagtctagcttcagctgtttatggtgatgctacattttggtttataaatatgtttgtggtataaaaaaatgagtataaccataggttttgaacaaatttccttacatttttcatacaaaaatcataaatatctgtatgctattgaaatttaactttgtatgatgcttaaaaaccactatttggggaaataataaaataagtctttaccatgtatgaaagaaattttaaaaaatacaaaatattttctgattagcatctagcttataataaattttcaaaaaagctgaaggcaaaaatgccttcatcaggatgcactgagaactatatagttacgtcctgctttttgtataaactgagatgctcacatgcttccccttagaacaggcaatgtgctatgcataacatagttgtacattatctttgcggttgctttgagttttattttttattatttaaaattgtagttataaaatttttcagtatagtacagtacatatactgtgaggcgcgtgctaaagtgaataagcgagttttcatgctgacccactcaatgctattcagaaatcaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtttggattctttgtactttttcatgttcagtacatcaataaacaaagttgaagggaaa

SEQ ID NO: 129375 - DNA, 2370 bp, Homo sapiens
  Payload ID: 5305
  Gene Symbol: ELAVL2
  Gene Name: ELAV like neuron-specific RNA binding protein 2
  Uniprot ID: Q12926
  ENST ID: ENST00000380117
  CDS Start-End: 545-1624
gagcctggcagagcagctgcacacacggcagtgcggaggcagagaaggggttggtgatacggtgctataaatctgtggtccagtccacctcccttttaagacgtcctcccccctatttctgttcttagttagagatgcagcagcttactcctgtagcgacctactaaaaagcaacaaggagaaagacatcgtctttttgaaaaaacgttctttcgtctcttttctttgttccttggtttgtttttcttgcccctttttgtttagttgaacggcaataggagggtagtctctccgtctttttaaactcttttttaagtttcccctcccctttcatattttttttcgccatttcttttagcattggactttggggtcgaaagcgtttctttttatttgcttcttttaagccgagcacagtttaggtttcgtgctgtcttaagagaactatccagcagcttcttgctcatccttattgggagaactgcaccgttactttaaaaacacacatacacaaaaaccttaagggagaaaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcata

SEQ ID NO: 129376 - DNA, 3805 bp, Homo sapiens
  Payload ID: 5305
  Gene Symbol: ELAVL2
  Gene Name: ELAV like neuron-specific RNA binding protein 2
  Uniprot ID: Q12926
  ENST ID: ENST00000397312
  CDS Start-End: 276-1355
caataggagggtagtctctccgtctttttaaactcttttttaagtttcccctcccctttcatattttttttcgccatttcttttagcattggactttggggtcgaaagcgtttctttttatttgcttcttttaagccgagcacagtttaggtttcgtgctgtcttaagagaactatccagcagcttcttgctcatccttattgggagaactgcaccgttactttaaaaacacacatacacaaaaaccttaagggagaaagcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcatatgacacctagtgagcttttaaaatttaccaggaaatttgcagcggttggaaaatttagaaagatttatggtgtagaaaatacttttgagatctttgtatgaaaggagtagaatcaatggggggaaacactgctggtttcatttttgtaatcaccagtggagcgtctgatcatcctggttattatgtgataggtggctcacattgatttgtgattttgaaacaaataaaaaaaatttacaaaagaatatataagagcaggcaagaaatttaaattaccgagagatgggggaaaaaatctgttcttcctaaagaaatcccttcagatagagctcatggtgtttagtgatgtacttgcagtattgtttgaagaattgttttgtcttaaggaaaaaagacgttgcacatgatttgtactgcagcaaatcagcaaaagtgatctgagttggatatatttgaaggtattttgaaagttacgttcaaggctaacacctgagctttgtgtaatgtaaataagaccttgtgtttatgaacctttcagctaatttaattttttttcccttacatgccaagtgatgttcaggttttgaatgtttttgtatcagttttttcctttgtaaatggcattaacattgttacttgaggtcttgcttaatcacttttgttgtcctgaggacttgaatttacagtgcatcagatttgttgcaaattttgtctgtagatagtctagcttcagctgtttatggtgatgctacattttggtttataaatatgtttgtggtataaaaaaatgagtataaccataggttttgaacaaatttccttacatttttcatacaaaaatcataaatatctgtatgctattgaaatttaactttgtatgatgcttaaaaaccactatttggggaaataataaaataagtctttaccatgtatgaaagaaattttaaaaaatacaaaatattttctgattagcatctagcttataataaattttcaaaaaagctgaaggcaaaaatgccttcatcaggatgcactgagaactatatagttacgtcctgctttttgtataaactgagatgctcacatgcttccccttagaacaggcaatgtgctatgcataacatagttgtacattatctttgcggttgctttgagttttattttttattatttaaaattgtagttataaaatttttcagtatagtacagtacatatactgtgaggcgcgtgctaaagtgaataagcgagttttcatgctgacccactcaatgctattcagaaatcaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtttggattctttgtactttttcatgttcagtacatcaataaacaaagttgaaggg

SEQ ID NO: 129377 - DNA, 777 bp, Homo sapiens
  Payload ID: 5305
  Gene Symbol: ELAVL2
  Gene Name: ELAV like neuron-specific RNA binding protein 2
  ENST ID: ENST00000423281
  CDS Start-End: 506-777
ggctcacgcctgtaatcccagcacattgggaggccgaggttggcagatcagttgaagccaggagttcgagacgagcctggccaacgtggcgaaaccctgtctctactaaaaatacaaaaaaatagctgggtgtggtgatgcatgcctgtaatcccagctacttgggaggccgaggcagaagaatcgcttgaacccaggaggtggaagttgcagtgatccgagatcatgcccactgccatccagtctggatgacagagagagagaccttgcctcaaaagaagaaagatttgaattaatggtttgaaaattcttagaacacttgaccacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggta

SEQ ID NO: 129378 - DNA, 723 bp, Homo sapiens
  Payload ID: 5305
  Gene Symbol: ELAVL2
  Gene Name: ELAV like neuron-specific RNA binding protein 2
  ENST ID: ENST00000440102
  CDS Start-End: 155-723
gctttcttcccttgcctttgaagactttctgcaggccctggaattgcctttgttcctctgtctgcccactttgccagtgtgaagcaggttttcatgggattctactggggtaaaccaaaagcagcagaaaaagtgtgaacaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaa

SEQ ID NO: 129379 - DNA, 3789 bp, Homo sapiens
  Payload ID: 5305
  Gene Symbol: ELAVL2
  Gene Name: ELAV like neuron-specific RNA binding protein 2
  Uniprot ID: Q12926
  ENST ID: ENST00000544538
  CDS Start-End: 260-1339
acaaacggcgggaccgcggcgcctgggcgtcactgaggcagtagccggccgggtgaggagggcggttgccggcgcggcgcggcgcggcgcgggtggggcgggggttccgccggcttccagtcccctttcccgccgccgccgccgccaccgcctctccgcggagctcgccccgagcgactcctccgcggcagtgctgacggccagcggcacgagccgtagtagctgcagcttcgagtcacagcagcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcatatgacacctagtgagcttttaaaatttaccaggaaatttgcagcggttggaaaatttagaaagatttatggtgtagaaaatacttttgagatctttgtatgaaaggagtagaatcaatggggggaaacactgctggtttcatttttgtaatcaccagtggagcgtctgatcatcctggttattatgtgataggtggctcacattgatttgtgattttgaaacaaataaaaaaaatttacaaaagaatatataagagcaggcaagaaatttaaattaccgagagatgggggaaaaaatctgttcttcctaaagaaatcccttcagatagagctcatggtgtttagtgatgtacttgcagtattgtttgaagaattgttttgtcttaaggaaaaaagacgttgcacatgatttgtactgcagcaaatcagcaaaagtgatctgagttggatatatttgaaggtattttgaaagttacgttcaaggctaacacctgagctttgtgtaatgtaaataagaccttgtgtttatgaacctttcagctaatttaattttttttcccttacatgccaagtgatgttcaggttttgaatgtttttgtatcagttttttcctttgtaaatggcattaacattgttacttgaggtcttgcttaatcacttttgttgtcctgaggacttgaatttacagtgcatcagatttgttgcaaattttgtctgtagatagtctagcttcagctgtttatggtgatgctacattttggtttataaatatgtttgtggtataaaaaaatgagtataaccataggttttgaacaaatttccttacatttttcatacaaaaatcataaatatctgtatgctattgaaatttaactttgtatgatgcttaaaaaccactatttggggaaataataaaataagtctttaccatgtatgaaagaaattttaaaaaatacaaaatattttctgattagcatctagcttataataaattttcaaaaaagctgaaggcaaaaatgccttcatcaggatgcactgagaactatatagttacgtcctgctttttgtataaactgagatgctcacatgcttccccttagaacaggcaatgtgctatgcataacatagttgtacattatctttgcggttgctttgagttttattttttattatttaaaattgtagttataaaatttttcagtatagtacagtacatatactgtgaggcgcgtgctaaagtgaataagcgagttttcatgctgacccactcaatgctattcagaaatcaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtttggattctttgtactttttcatgttcagtacatcaataaacaaagttgaaggg

SEQ ID NO: 129380 - DNA, 4729 bp, Homo sapiens
  Payload ID: 5306
  Gene Symbol: ELAVL3
  Gene Name: ELAV like neuron-specific RNA binding protein 3
  Uniprot ID: Q14576
  ENST ID: ENST00000359227
  CDS Start-End: 426-1529
cgcagcgcgggccggagggagggagggagggtgggcgaggggagaggacttgaacacacgggaccggacaggaccgaccgaggggcggcggcgaaaggcagagcgccgcgatctctgtcgggaagcgcaacctccccgggccccgcggggccgcgcagggggcgtcctcaaccccgcgcccgctccctctttccatcccctgccgcccgcaggccaccccggggcccggccatccgcgcgcgcatccccgggttcgggcccgtccctggccctcgagggagccgccgccttcatcgccacatctgcagcggccgcaccagaggccgcccgggcgggaccccagcgtgagcatcgggcgcccccctaggagtgcaccacccccggagcccccctcaacacggaccgcgcccgccgggcacacaagaatggtcactcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagggcagagccttggctacgggtttgtgaactattctgaccccaatgatgcagacaaagccatcaacaccctcaacggcctcaaattacagacgaagaccatcaaggtgtcctatgccagacccagttcagcatccatccgggatgctaacctgtacgtcagcgggctccccaagaccatgagccagaaagagatggagcagctcttctcccagtacggccgcatcatcacgtcccgcatcctggtggaccaggtcacaggtgtctctcggggtgtgggattcatccgctttgacaagaggattgaggccgaagaggctatcaaaggactgaatgggcagaagccgctgggcgcagctgagcccatcacagtcaagttcgcgaacaacccaagtcagaagacggggcaggcgctgctcacccacctctaccagtcatccgcccggcgctacgcaggccccctacaccatcagacccagcgtttccggctggacaatttgctcaacatggcctacggcgtcaagagtcccctgtcgctcatcgccaggttctcgccgatcgccatcgatggtatgagcggcctggcgggcgtgggcctgtcggggggcgcggcgggcgccggctggtgcatcttcgtgtacaacctgtcaccggaggcagacgagagcgtgctgtggcagctgttcgggccttttggggcagtcaccaacgtcaaggtcatccgtgatttcaccaccaacaagtgcaagggtttcggcttcgtgaccatgaccaactatgacgaggcggccatggccatcgccagcctgaacggctatcgcctgggcgagcgcgtgctgcaggtctccttcaagaccagcaaacagcacaaggcgtgagcccaccccgcctgccctcccaccccctccccgggcagcagagagagagagagagaaagagagagagagagagagaaggggcccaagagagacagcacaggcagccccacggacgacgcgagggccccacgtccctgcggaagccacagggtgagcactctggggtgggagggtctgcagggaattgggggggtgcccggggatcccccgccccatcctcctgcccccaccccaggctgggctgttcactctctcgtcttggtttggttcatggtgaaggtttttgtttcttttttcggctaaaaagaatgcagagatgtgcccccacccccaccctcgaccacccccgatgggatggcttggggggctccagggggtgccctcccagacccccttgcccaggcctccccagcacctaggtggggcctggggtaggaggaacaggtttaaaaatccccaaaaaagcgaaccgtgaggaggggtgtgggcacccccggcccagtgccccctggtggaatgcgggggagcaggcagtggggctggaagcagaaacaaaatgaaaaaaaaaggggggtgggaggggaagaaaaactctatttttgtaaaaagggaaaaagacctcgtggagaatttttactggggattcttgaacttgaaaaaaaaaaacacaaaaaaagacaaaaaaaaaaaaagaaaatattttggcaggttatgtttaccaactggggcgggggtggggggggcccagggagcagggcttaggggctagcagcccacggggccacacagagaaacaaccacgcagacagtcacaccacggggacacacggacagacgcagacggacacagcgacatgccccagacacgttaagggactggttggccaaactcagacacgtggacagggatagacagaaagagacagaagctggggctacgtccatgtggacacagaccacagatgtgggcacacgaatccatccacctgtccacgtgcacacgtgaatgtagcgatagatatttggacatcaaatttggacaccaggtcacggagaaacacaaacaccacccaggaacacgcagacatatgcccatagcatcccacaggcccaggcaggaggtcccaccccagaccctgccccagacgctccctcaccctctcggccccctcgccctggcccccaggttctctgcagagatctctcctggacccccagcggtctccttggcgcccacgaacacaggcgtgcacacgcagcgcacatgcattgagacacacgatacctcgttccaccttggcgtcacggtgggctggaggcagcccccccccccacaacacttgaggccaaaggacacccctgtccccggggctcagcctccccctgggccgaggccttggcccacacagctgagggagaggcccagccctgagcctcccccaccaggactgggcctccccggcagcaagaccccggcactccccgccaggcccagggtggggtggatgggcccaaaggcccagccccacactcctttcccgtccacttgtcacctacctatcccctttcggtttgttgggtttttcgtctttccagattgcagtggacacagcccccgatctcgagccccggcccccggcttctgtctggacattgcatcgccctagttttctttctttaaaaaaaaaaaattccaacagaagccacaggccggagcccctgggagccctcgcaccgctccccaccccactcagcggccccatcggaactgagaattgcaaaacccccgactttagctatagttaagttgccttcccccggtgtccccacgtttggtgtctggctatggcgcccccatctgactgtccagctctctctcccccacccctcccggtgttgttattaaacgtctgtggagcttctgctgcaaggaacaaaaaagaaaaaaatcaaaaaagcgacaaaaaaacacaaacagaagaggaaaaaaaagcaacaaaaaaagaaaacacacagaagagatttaaaaaaaaaaaaggaaaaaaaaaaaagacataaactggcaccagttaactttcttgtacttttttgctgaatttagcttcttgtagttttaacttattgctatgttaactatttattctcctcgttgccctgtaaggacatccgtgtatatttctgttacttcatccggtttgcaagttaaaggaacgacaatgttctctttgtttctttaagttttgccgagacatggttatgcctaatttatttataaaaggggaagtggaatcattaaagtaataataattattaataacagtaatggtagccgagtggcacgcgggggcgtgtgctctgcgggacagtccccacggccagcgacgtccaggtcaccaatgggattctttttgctcttgtcttgagaattttttcagtcctatttagctggtgaaatccctagcttgttcttgatacacgaacctatttattctcgtggttttaagtcctccctgccctctctcctctcccctgcagcagggcagggacccctctcccctgctgtctcttggggctctctcccctccgccctctgcattcgggaacacgcacgtccgcgtgggaagcttgcagcagggcgtccgagcaataagggctgggtttgtcccccaccctggggggggccaggctccagagagggggcacctccccacacaccccccccccaccgaggcctaggcccctgccacccccaagactgggaggggacttctttttctaaaacacaaaactcagcccagccaggccccctccctggaggccagcccctccccgcagggggccaggccggggctcccaggcgagggggacttggggcttccacgtccctggggggcaggggccaggccaggggggagggggctcagcccctccacccctcccttcatcctgttatttattcggaaggtttcaaatcacgacagagtccatgttggaggtgataaaaaactgtaaaaaaaaaaaaaaaaaaaaagacaaaacaaaagacaaaaaaaaaaaaaaaacccaacaagaacacttcgcgttgcgtttagactatttattaccgggatcacaggcctggccgcggtaacagacttttacatggaattgtttaattatttgtacttttcatgccagaaaataaaagttcagaatcttaa

SEQ ID NO: 129381 - DNA, 1223 bp, Homo sapiens
  Payload ID: 5306
  Gene Symbol: ELAVL3
  Gene Name: ELAV like neuron-specific RNA binding protein 3
  Uniprot ID: Q14576
  ENST ID: ENST00000438662
  CDS Start-End: 18-1100
ccgccgggcacacaagaatggtcactcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagggcagagccttggctacgggtttgtgaactattctgaccccaatgatgcagacaaagccatcaacaccctcaacggcctcaaattacagacgaagaccatcaaggtgtcctatgccagacccagttcagcatccatccgggatgctaacctgtacgtcagcgggctccccaagaccatgagccagaaagagatggagcagctcttctcccagtacggccgcatcatcacgtcccgcatcctggtggaccaggtcacaggtgtctctcggggtgtgggattcatccgctttgacaagaggattgaggccgaagaggctatcaaaggactgaatgggcagaagccgctgggcgcagctgagcccatcacagtcaagttcgcgaacaacccaagtcagaagacggggcaggcgctgctcacccacctctaccagtcatccgcccggcgctacgcaggccccctacaccatcagacccagcgtttccggctggacaatttgctcaacatggcctacggcgtcaagaggttctcgccgatcgccatcgatggtatgagcggcctggcgggcgtgggcctgtcggggggcgcggcgggcgccggctggtgcatcttcgtgtacaacctgtcaccggaggcagacgagagcgtgctgtggcagctgttcgggccttttggggcagtcaccaacgtcaaggtcatccgtgatttcaccaccaacaagtgcaagggtttcggcttcgtgaccatgaccaactatgacgaggcggccatggccatcgccagcctgaacggctatcgcctgggcgagcgcgtgctgcaggtctccttcaagaccagcaaacagcacaaggcgtgagcccaccccgcctgccctcccaccccctccccgggcagcagagagagagagagagaaagagagagagagagagagaaggggcccaagagagacagcacaggcagccccacggacgacgcgagg

SEQ ID NO: 129382 - DNA, 367 bp, Homo sapiens
  Payload ID: 5306
  Gene Symbol: ELAVL3
  Gene Name: ELAV like neuron-specific RNA binding protein 3
  ENST ID: ENST00000588853
  CDS Start-End: 90-367
accccagcgtgagcatcgggcgcccccctaggagtgcaccacccccggagcccccctcaacacggaccgcgcccgccgggcacacaagaatggtcactcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagacaaagccatcaacaccctcaacggcctcaaattacagacgaagaccat

SEQ ID NO: 129383 - DNA, 1442 bp, Homo sapiens
  Payload ID: 5307
  Gene Symbol: ELAVL4
  Gene Name: ELAV like neuron-specific RNA binding protein 4
  ENST ID: ENST00000357083
  CDS Start-End: 13-1221
tgccggcgactgatgctgagatatctgcaacctttgggatgtgtgcatggtggcaaggggctgactgatatgagattacttcttttaagggaaattgtcattaatgagtcaagaaactgctcatttatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaa

SEQ ID NO: 129384 - DNA, 2467 bp, Homo sapiens
  Payload ID: 5307
  Gene Symbol: ELAVL4
  Gene Name: ELAV like neuron-specific RNA binding protein 4
  ENST ID: ENST00000371819
  CDS Start-End: 236-1351
aaagagagtgatttatttgggcttcagtaaatgctgcatcttgtatttcaaagagtttcctgtcatgacctcataaaaaagaggaggcggcttgtatgtgtagcagtgcctggcgtgttgagttgttgcttccttctctgggcagcagctctgtaagaaggaatgtcagcttttacataacgttcctttccgcttttgacacactgtgtgagggtccatcttcttctgatcacagatggagtggaatggcttgaagatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaa

SEQ ID NO: 129385 - DNA, 3349 bp, Homo sapiens
  Payload ID: 5307
  Gene Symbol: ELAVL4
  Gene Name: ELAV like neuron-specific RNA binding protein 4
  ENST ID: ENST00000371821
  CDS Start-End: 316-1473
taaacctcgagaggcagctcctggatactgaacactgagatgggcagttgtgtttcgggggactgcgcagtcaaaacggcaaagagagtgatttatttgggcttcagtaaatgctgcatcttgtatttcaaagagtttcctgtcatgacctcataaaaaagaggaggcggcttgtatgtgtagcagtgcctggcgtgttgagttgttgcttccttctctgggcagcagctctgtaagaaggaatgtcagcttttacataacgttcctttccgcttttgacacactgtgtgagggtccatcttcttctgatcacagatggagtggaatggcttgaagatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagagactgatgtctggaccagtccccccttctgcttgtccccccaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgtatgtgtatatacaatataaatatatatatataaagttattttttctttgggttaatttattataagttgtaacacttggctagttttgtttgtatatgtcttaaaatgttttcttatgatatttaagtgacagttaaagaggtatcaaggtaacttgtgtagaactattctttgatatattgtcatgtttgttgtgaatattttttcttactgcacagtagaaaaataaaaacaactgagtctttattttaatgtaactcagattggggaaaacaaaacagagctaagggaacaaaatgactgagggagcactctcccacgtccagtgcactgatcattttagtatgtttgtgctttgtacggttatatatttaaaacgaaaacaaaacaaaaaaatacaa

SEQ ID NO: 129386 - DNA, 1591 bp, Homo sapiens
  Payload ID: 5307
  Gene Symbol: ELAVL4
  Gene Name: ELAV like neuron-specific RNA binding protein 4
  Uniprot ID: P26378
  ENST ID: ENST00000371823
  CDS Start-End: 225-1367
tagaatcgggggtttcagctcactgctccttttcttttttttctttctctcccccgcccacccccccaaaaataattgatttgctttacaatcatccacactgtgttttgtggatctttaattatatataacaatagtagtcattttaaatatatattctgaaatctttgcaaattttaacagaagagtcgaagctctgcgagacccaatatttgccaataagaatggttatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagagactgatgtctggaccagtccccccttctgcttgtccccccaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaa

SEQ ID NO: 129387 - DNA, 3966 bp, Homo sapiens
  Payload ID: 5307
  Gene Symbol: ELAVL4
  Gene Name: ELAV like neuron-specific RNA binding protein 4
  Uniprot ID: P26378
  ENST ID: ENST00000371824
  CDS Start-End: 258-1358
caaggctctgttcagttgttcttatctacatcctagaatcgggggtttcagctcactgctccttttcttttttttctttctctcccccgcccacccccccaaaaataattgatttgctttacaatcatccacactgtgttttgtggatctttaattatatataacaatagtagtcattttaaatatatattctgaaatctttgcaaattttaacagaagagtcgaagctctgcgagacccaatatttgccaataagaatggttatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgtatgtgtatatacaatataaatatatatatataaagttattttttctttgggttaatttattataagttgtaacacttggctagttttgtttgtatatgtcttaaaatgttttcttatgatatttaagtgacagttaaagaggtatcaaggtaacttgtgtagaactattctttgatatattgtcatgtttgttgtgaatattttttcttactgcacagtagaaaaataaaaacaactgagtctttattttaatgtaactcagattggggaaaacaaaacagagctaagggaacaaaatgactgagggagcactctcccacgtccagtgcactgatcattttagtatgtttgtgctttgtacggttatatatttaaaacgaaaacaaaacaaaaaaatacaagggttcatgctcttccctgggtaatagaaacagttactcgctatgcataatctagttgatagttaaatttgctattgcttttcttgtcttgttatataaaatcttttcaatacaagtttagtcttaatggtaataaaacgttatggttatttataacttgtgcttattttgtgcattttttcccatgctgaacccactaagtgcatgtagacaggactgttgttttcacactgaaaaggcaaactttgtagtagtcgttgtagtggtagacagataacgaataccaaggctgcatcatagactcctcctttaaattttttttctgtttttttttcctcttttcggttttggatataacaccagatttcagttcagagaacactcgttcaacattcagggaaagctttttacgtcacctgctatgaatgaacgtagtttgctggcaaagttttgatgcatttgctaagcattagtgggaaaggcatgccaaaatcttctctataatgtgttcaatcttgggggaaaaaaaaaggaaaaaaaatcttaggaccaggcagttgtatactttagttattaatgaatgacttcatgttaatcttgctagtttagatgatttccaagggaaagtattgtaaatgtttttttttcataatcttgttgtgtttgaattatttgtactttatctgtccagacaataaatgaaagtgtgtagaatggatttgacttcccaaa

SEQ ID NO: 129388 - DNA, 3775 bp, Homo sapiens
  Payload ID: 5307
  Gene Symbol: ELAVL4
  Gene Name: ELAV like neuron-specific RNA binding protein 4
  Uniprot ID: P26378
  ENST ID: ENST00000371827
  CDS Start-End: 83-1183
gtctgacttggagttttgtgctgttgcacgtgaatgctctggaactgccctaatcgactgaaaatgagccggctacagtcatatggaacagataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgtatgtgtatatacaatataaatatatatatataaagttattttttctttgggttaatttattataagttgtaacacttggctagttttgtttgtatatgtcttaaaatgttttcttatgatatttaagtgacagttaaagaggtatcaaggtaacttgtgtagaactattctttgatatattgtcatgtttgttgtgaatattttttcttactgcacagtagaaaaataaaaacaactgagtctttattttaatgtaactcagattggggaaaacaaaacagagctaagggaacaaaatgactgagggagcactctcccacgtccagtgcactgatcattttagtatgtttgtgctttgtacggttatatatttaaaacgaaaacaaaacaaaaaaatacaagggttcatgctcttccctgggtaatagaaacagttactcgctatgcataatctagttgatagttaaatttgctattgcttttcttgtcttgttatataaaatcttttcaatacaagtttagtcttaatggtaataaaacgttatggttatttataacttgtgcttattttgtgcattttttcccatgctgaacccactaagtgcatgtagacaggactgttgttttcacactgaaaaggcaaactttgtagtagtcgttgtagtggtagacagataacgaataccaaggctgcatcatagactcctcctttaaattttttttctgtttttttttcctcttttcggttttggatataacaccagatttcagttcagagaacactcgttcaacattcagggaaagctttttacgtcacctgctatgaatgaacgtagtttgctggcaaagttttgatgcatttgctaagcattagtgggaaaggcatgccaaaatcttctctataatgtgttcaatcttgggggaaaaaaaaaggaaaaaaaatcttaggaccaggcagttgtatactttagttattaatgaatgacttcatgttaatcttgctagtttagatgatttccaagggaaagtattgtaaatgtttttttttcataatcttgttgtgtttgaattatttgtactttatctgtccagacaataaatgaaagtgtgtagaatg

SEQ ID NO: 129389 - DNA, 1951 bp, Homo sapiens
  Payload ID: 5307
  Gene Symbol: ELAVL4
  Gene Name: ELAV like neuron-specific RNA binding protein 4
  Uniprot ID: P26378
  ENST ID: ENST00000448907
  CDS Start-End: 152-1261
aggtgggcagggggtggcggcggcgacggtggcggagccgcagagcgagctagagagcgagagcggtgagactctgcggacgtcttcccgcccgccgcgctccgccccacccagcctccgcagcctcgggccggatcgcccggcggggaagatgcgcctcaagaaccagataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgcc

SEQ ID NO: 129390 - DNA, 2312 bp, Homo sapiens
  Payload ID: 5308
  Gene Symbol: ELAVL1
  Gene Name: ELAV like RNA binding protein 1
  Uniprot ID: Q15717
  ENST ID: ENST00000351593
  CDS Start-End: 124-1104
ccgtcgccgccacctccgccgccgcttcgacccctgcagaggttcctgggccgccgccgcctcctcactggaccgggcagccccgggcccagccccctcccctccagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctatggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggctgcatgctgggcgggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcg

SEQ ID NO: 129391 - DNA, 6015 bp, Homo sapiens
  Payload ID: 5308
  Gene Symbol: ELAVL1
  Gene Name: ELAV like RNA binding protein 1
  Uniprot ID: Q15717
  ENST ID: ENST00000407627
  CDS Start-End: 131-1111
ccgtcgccgccaccgccgccaccgctaccgaggccgagcggagccgttagcgccgcgccgccgccgcctcccgcccgccccggagcagccccgggcccgcccgcccgcatccagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctatggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggctgcatgctgggcgggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcgaattttgttttgttttttattttaccttttctttctttttggctagggaaggtgcaggtggcccagcattcagggaggagtcgtaagatcttaagaaaccaatccttgcctcaagcaaaagcatttctgaatctgtgacgcaagaatgtgcagttacaggctggtggcttttaaaccaggagcccggaggaagggtgaaagagaaagcctgtgaaataggcagggccagatcacccaaaactcctcaggactgggatctggcgtttataaataactagtttacagagagaatcacaaacaggataacttagtaccagcagtttttaaccttgacgtgagactaaaacgtgaccgtaggctgttttttagttattgctctcatgagatgatggctgtatttatctgtttatttatacctatttatgtatttatttattgaagtgtgaaattgagcaataggcaggcaccaccgtccccagagcaggtcagcgtctcgagaggcccctggacaattgaggatgcccatcccctcccctttccctgatcttttactgaggggctgtgtgcgcgatccttgcaaattgatgatgttgccatccgtacccaggctgtgtctcataaaagtcggcctggtgccagagaggacctcctttctcccacagaatcccagatcctcaggaaaagccaaaaccgaggcccattgcccggattcgacacaaaagagggtccctgctctgttgcccgagagcagtctgcatcctgggaccagaatgctttcctggaaaaagaagcctttcaggtttccctgggccagcatcttctgatggaaggtgggagccaacacccttctgatggaaggtgggagccaacacccttctgatggaaggtgggagccaacacccttctgatggaaggtgggagccaacacccttctgatggaaggtgggagccaacacccttctgatggaaggcgggattcccgcttctgaaactccccctggagtctcactcccacacatgcccatagctagcattcaacagagaactctgtcttaagcttcaactgtgaaaatgatgacgggcttgtagcacctcagcttctttcctcgcccccttttatctgaatcctatcaattattctgatgctgggacaggtgagaagaaactgtgaagtatatgagcctttgaaagttccctgaagtttctcagttcaggaacattctcattgtatgtggtctccgctgtttgaacagccttctagctaaaaaattccaaagcctttatttgggagtcttagcttgcaagcttgtggaaggatttagcttaacaactgtcactcctgaaaagcaatctctgttccatcaaggttctagttgctggccctgtgtcctcaaagttcattacatcttatcaaggcctgtttgcaaaggggagatcccttttcttaaaaaaggctcaacccaaaagaaaccatttcttaaaaaattttacatagatcagttgtatttctatttagcaaaaatgagtgctctgcttttatttgggaatttcgatgaaaaagcgttcagagtagataatgttcatttatcaaaaatctggtttgggaaataccaaagaggctttgattgaattcccttttgacccgtgtgtaacttcctctggtagttagaccccaggcagctccgaatttgtgaacctgcttcctgatgaattctcccttgttcccccttggctctgccattatttcgttttcagtgtaatttgccaagccgcagttttctgtgctggctgtgcctctagtcgcagctctgtgactgattccctcccgggtgctgagtcccctccccggccaccatcctgcgtgaatatcctgaaattcatgggcttcctcgggggcccgcccgcaggtggtgctgggtgggttccgccaccttctcctggaaggtgagccttttcctggccaagggcagctgccttaacctctgagagtctgcgcttggccttagtcctggagacccagcctccagggactgaaccgtgctgctgttgggagccaagaccggccctttggagccggcagcccaggggtccctgctggatcagagaaatagaagcacccgaagacggttagtggcaattccttgacccggtttgcttccaaatgaaggccatttgtccaccaggcattgaaaagacatgacttacccagtccggcatcggacttgaaaaatcgaaattgacatcactcagctgttacatttcacatccgattcagcccccttttatttccatgtgcttttcgcagccttcctgtgttggatgaaagagaataagaattcagctgacaggaggcctctatcctgtccctccaccccaccctccacctcaatcccctcccatcttccccagacctacctcacctactaggacctgaggcagctccttagcagagacccctggggtttagctgactctgggggtcaggggttcctgtccccaaacttcgcaagacagccctgaagtcacaagtgctttcttttaagtggcattggcaattggcgtgtaatgatggcagtagaatctgaatctcggatcccaggcagggttcacatttccaaacctttttgatttcccctgacctctaatggctggatcctatttttctacaacctttcagtgacatcgttcaggtttctttcttggccatttaaaaaaacaaattttttttttctcacttgtaagtcaccgccagtacctaagttaggctaacggagactttgacaggactggatttttcttccaccagaagagaagccttttccgttggtttggggccacctctttgaccatgaccatgtgatgttccgtttacagtgacttgctttgggggaggggaggctctcttaaccgattcccatgttgtacagtagatggttagaccttttgtatattagtgtgttttaagttattgatttgttttatataaaataatttatttttcaggtgccatttttcattttaactttgtttttacatgggtttgttttcaataaagtctgacactggtgtccaaaagtcaacaataaaatgaatcccattgtgttcttttgaagatgcctatgtaacttttaagctttttaaattattttcagaaaaaaaaaaagaaaagcccttatcagttttccatcagcccattgcctttttattttttttttttaatccttgtgaataaatgttctttagtgttttaggaggaaaaagcaaacctagattttgataacccagaagacttcagattaataaagaagctttgaaagaagaccatttttcaaaattttagtgaagtgtgaatattttttgtcaatggctttctcaaagagaatgaaacttttgcaccattttcagagtttttatagagatgccaaattgatatatttacatgtaatggaaacatgaaaaagttttattaaacaattgttcatagctgtgtagacattttaattcagtttccaaagctctcaaaaaatcgtatttttgaagtacggagtgatgcggtttggggcgtggcttacagttccaacgactcaattgtcccgatactcagttctttctacaggtatcaggttcgtgttaaacgctgtatgttaactatgactggaattctgtgatattttggtaataaatgaagtgggatca

SEQ ID NO: 129392 - DNA, 856 bp, Homo sapiens
  Payload ID: 5308
  Gene Symbol: ELAVL1
  Gene Name: ELAV like RNA binding protein 1
  ENST ID: ENST00000593807
  CDS Start-End: 182-643
cgcgggccggagcgggtcgtgcgcgctgaggaggagccgctgccgccgtcgccgtcgccgccaccgccgccaccgctaccgaggccgagcggagccgttagcgccgcgccgccgccgcctcccgcccgccccggagcagccccgggcccgcccgcccgcatccagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctatggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacagttattccgcaaacgaggacagcaccaaaatgagaagacgttggctttggtttgaggaggctgaggaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgac

SEQ ID NO: 129393 - DNA, 880 bp, Homo sapiens
  Payload ID: 5308
  Gene Symbol: ELAVL1
  Gene Name: ELAV like RNA binding protein 1
  ENST ID: ENST00000596154
  CDS Start-End: 1-402
ggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacagaatcccagatcctcaggaaaagccaaaaccgaggcccattgcccggattcgacacaaaagagggtccctgctctgttgcccgagagcagtctgcatcctgggaccagaatgctttcctggaaaaagaagcctttcaggtttccctgggccagcatcttctgatggaaggtgggagccaacacccttctgatggaaggtgggagccaacacccttctgatggaaggtgggagccaacacccttctgatggaaggtgggagccaacacccttctgatggaaggtgggagccaacacccttctgatggaaggcgggattcccgcttctgaaactccccctggagtctcactcccacacatgcccatagctagcattcaacagagaactctgtcttaagcttcaactgtgaaaatgatgacgggcttgtagcacctcagcttctttcctcgcccccttttatctgaatcctatcaattattctgatgctgggacaggtgagaagaaactgtgaagtatatgagcctttgaaagttccctgaagtttctcagttcaggaacattctcattgtatgtggtctccgctgtttgaacagccttctagctaaaaaattccaaagcctttatttgggagtcttagcttgcaagcttgtggaaggatttagcttaacaactgtcactcctgaaaagcaatctctgtt

SEQ ID NO: 129394 - DNA, 1473 bp, Homo sapiens
  Payload ID: 5308
  Gene Symbol: ELAVL1
  Gene Name: ELAV like RNA binding protein 1
  Uniprot ID: Q15717
  ENST ID: ENST00000596459
  CDS Start-End: 169-1149
aagcccggaggtgggaacatcgcagtgttcagagaacatcgtgtgttcaaagaaccacgtgggttctttagggacaagaaggctgagatgggtagtggtggcaggagtgctcaggtgtccactgggcagagggcttggctgttaccctgcagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctatggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtct

SEQ ID NO: 129395 - DNA, 1289 bp, Homo sapiens
  Payload ID: 5309
  Gene Symbol: ETFA
  Gene Name: electron-transfer-flavoprotein, alpha polypeptide
  ENST ID: ENST00000267950
  CDS Start-End: 61-255
gcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaactttttaaattctgtactaaaatctataataaagcttttccacagctttaaaactatcagaaatatgcctagcctctagagaaaattgaagaaaaggagt

SEQ ID NO: 129396 - DNA, 1346 bp, Homo sapiens
  Payload ID: 5309
  Gene Symbol: ETFA
  Gene Name: electron-transfer-flavoprotein, alpha polypeptide
  Uniprot ID: P13804
  ENST ID: ENST00000433983
  CDS Start-End: 17-871
ggcggaagcggagaccatgttccgagcggcggctccggggcagctccggcgggcggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaactttttaaattctgtactaaaatctataataaagcttttccacagctttaaaactatcagaaatatgcctagcctctagagaaaattgaagaaaaggagtaaaaattttgtttatttatttatttttttgcctttcttgttcatggagagctctatgttttaggaagattgtaaacatgattgtctccaccagcctaatcaacctactaatctcattgttgaagggcaaacttcataggagaaggtaactgaattggcaagtgcag

SEQ ID NO: 129397 - DNA, 792 bp, Homo sapiens
  Payload ID: 5309
  Gene Symbol: ETFA
  Gene Name: electron-transfer-flavoprotein, alpha polypeptide
  ENST ID: ENST00000559602
  CDS Start-End: 27-716
ccgaggttgcggcggaagcggagaccatgttccgagcggcggctccggggcagctccggcgggcgaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataa

SEQ ID NO: 129398 - DNA, 2287 bp, Homo sapiens
  Payload ID: 5309
  Gene Symbol: ETFA
  Gene Name: electron-transfer-flavoprotein, alpha polypeptide
  Uniprot ID: P13804
  ENST ID: ENST00000557943
  CDS Start-End: 82-1083
attaggtgactggctgaggcggcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaactttttaaattctgtactaaaatctataataaagcttttccacagctttaaaactatcagaaatatgcctagcctctagagaaaattgaagaaaaggagtaaaaattttgtttatttatttatttttttgcctttcttgttcatggagagctctatgttttaggaagattgtaaacatgattgtctccaccagcctaatcaacctactaatctcattgttgaagggcaaacttcataggagaaggtaactgaattggcaagtgcagagttaaaaaagcacggctataaagcatgaatattatcttaaacatactccagtcttcagaagaccatagctaatgtgacaaaagcagacctgacttaaacctgacccagctccatgtatttagttggcttaaggtaaatttcattttccgtttaattttaaggttttgtcagtttataggacttttgtctgtaaaggagggagagtggaggaggggctgctttgagacagcatggcctctgatgcaagcagatagtttgatgttattataaacattcaaaatcctgtgcagagaatgctctagcctttcttttgccttctgttggcttcttttgggctctcttaggaagcacccaggcctgtgtagtcacctctggcactctcattctgctgcccagggcacagctgaggtccaagagtgtcaccagggctgcagctggtgtggatgcaggcccaagagcagaggctggtgaggctttgaacaggcctgcaggaaggcgtgggtaggtaggtgagtagaacaaagagggctgccctcctgaatcagatctgcagaagtaggagtagtgacctggatcaagcagacagtagggaagagaagggaagtgataagtgatggaggtggctagagtgcctttgtgtgaccagcctggggcccttccccagctgactagtgaaccctttctgatttgtgtcacaatcagttgctataaaacacttttaaaagttg

SEQ ID NO: 129399 - DNA, 893 bp, Homo sapiens
  Payload ID: 5309
  Gene Symbol: ETFA
  Gene Name: electron-transfer-flavoprotein, alpha polypeptide
  ENST ID: ENST00000559386
  CDS Start-End: 26-893
cgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtgatggagtttcgctcttgttgcctaggctggagtgcaatggcacaatctctgctcaccgccacctccacctcccaggttcaagcgattctcctgcctcagcctcccgagtagctgggattacaggtcgaggcttgaagagtggagagaactttaagttgttatatgacttggcagatcaactacatgctgcagttggtgcttccc

SEQ ID NO: 129400 - DNA, 1054 bp, Homo sapiens
  Payload ID: 5309
  Gene Symbol: ETFA
  Gene Name: electron-transfer-flavoprotein, alpha polypeptide
  ENST ID: ENST00000560044
  CDS Start-End: 85-222
agcattaggtgactggctgaggcggcgccagttggccgggcacggggctgctgtaaggccgaggttgcggcggaagcggagaccatgttccgagcggcggctccggggcagctccggcgggcgagacggggtttccccatgttacccaggctggtctcgaactcttgtcctcaagtgatccacctgcctcggcctcccaaagtcctggaattacaggcctgagctaccgcacctggccttagacatcttttttcttgcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttgga

SEQ ID NO: 129401 - DNA, 717 bp, Homo sapiens
  Payload ID: 5309
  Gene Symbol: ETFA
  Gene Name: electron-transfer-flavoprotein, alpha polypeptide
  ENST ID: ENST00000560345
  CDS Start-End: 1-717
ggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtgtagagacggaggttctgcatgttggtcaggctggtctcgaaatcctgacctcaggtgatccgcccacttcagcctcccaaagtgttgggattacaggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagt

SEQ ID NO: 129402 - DNA, 942 bp, Homo sapiens
  Payload ID: 5309
  Gene Symbol: ETFA
  Gene Name: electron-transfer-flavoprotein, alpha polypeptide
  ENST ID: ENST00000560726
  CDS Start-End: 630-851
aggtgactggctgaggcggcgccagttggccgggcacggggctgctgtaaggccgaggttgcggcggaagcggagaccatgttccgagcggcggctccggggcagctccggcgggcgaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagc

SEQ ID NO: 129403 - DNA, 917 bp, Homo sapiens
  Payload ID: 5309
  Gene Symbol: ETFA
  Gene Name: electron-transfer-flavoprotein, alpha polypeptide
  ENST ID: ENST00000560595
  CDS Start-End: 9-917
cggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtgttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatg

SEQ ID NO: 129404 - DNA, 910 bp, Homo sapiens
  Payload ID: 5309
  Gene Symbol: ETFA
  Gene Name: electron-transfer-flavoprotein, alpha polypeptide
  ENST ID: ENST00000560899
  CDS Start-End: 578-697
ccgaggttgcggcggaagcggagaccatgttccgagcggcggctccggggcagctccggcgggcgaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagcatgtttctctggattagcagttacctggactataccatgttccaatcttagacattctggcatcttctgcacatctctctgaggaacccctctaagggaaatacacagatgttggatatcctgtagcctgtattttaagtcaggctacatcaaaatacttaatgtattttttaataccagctgttttcacaacatacaatgccagacaattgtggcaattaataaagacc

SEQ ID NO: 129405 - DNA, 633 bp, Homo sapiens
  Payload ID: 5309
  Gene Symbol: ETFA
  Gene Name: electron-transfer-flavoprotein, alpha polypeptide
  ENST ID: ENST00000560309
  CDS Start-End: 56-193
agttggccgggcacggggctgctgtaaggccgaggttgcggcggaagcggagaccatgttccgagcggcggctccggggcagctccggcgggcgagacggggtttccccatgttacccaggctggtctcgaactcttgtcctcaagtgatccacctgcctcggcctcccaaagtcctggaattacaggcctgagctaccgcacctggccttagacatcttttttcttgcctcattgctacgatttcagagtaccctggtaatagctgagcatgcaaatgattccctagcacccattactttaaataccattactgcagccacacgccttggaggtgaagtgtcctgcttagtagctggaaccaaatgtgacaagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgc

SEQ ID NO: 129406 - DNA, 804 bp, Homo sapiens
  Payload ID: 5309
  Gene Symbol: ETFA
  Gene Name: electron-transfer-flavoprotein, alpha polypeptide
  ENST ID: ENST00000559973
  CDS Start-End: 1-763
ggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaagcccccttggacagctctcctctgtccaagcagtcacaaagcagctctacactggaagctccagttgcagccactgcactgccacgactaagggtagttcctgaaatgactgagatattgaagaaaaaatga

SEQ ID NO: 129407 - DNA, 609 bp, Homo sapiens
  Payload ID: 5309
  Gene Symbol: ETFA
  Gene Name: electron-transfer-flavoprotein, alpha polypeptide
  ENST ID: ENST00000565910
  CDS Start-End: 1-141
gaactttatattgctgttggaatatctggagccatccaacatttagctgggatgaaagacagcaagttacctggactataccatgttccaatcttagacattctggcatcttctgcacatctctctgaggaacccctctaagggaaatacacagatgttggatatcctgtagcctgtattttaagtcaggctacatcaaaatacttaatgtattttttaataccagctgttttcacaacatacaatgccagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaactttttaaattctgtactaaaatctataa

SEQ ID NO: 129408 - DNA, 900 bp, Homo sapiens
  Payload ID: 5310
  Gene Symbol: ETFB
  Gene Name: electron-transfer-flavoprotein, beta polypeptide
  Uniprot ID: P38117
  ENST ID: ENST00000309244
  CDS Start-End: 93-860
gcagagaggggcgcggggggcgggggtggtggggcttctggactgagccgctgagggtgcgggctgaccctgtaagtggctgcggcgggaagatggcggagctgcgcgtgctcgtagctgtcaagagggtcatcgactacgccgtgaagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctcaacatc

SEQ ID NO: 129409 - DNA, 3551 bp, Homo sapiens
  Payload ID: 5310
  Gene Symbol: ETFB
  Gene Name: electron-transfer-flavoprotein, beta polypeptide
  Uniprot ID: P38117
  ENST ID: ENST00000354232
  CDS Start-End: 2469-3509
gcgagagcccatctaaaaaaaaaaaaaaaagaaattagaaacagggtctttgcagatgtgattaaattaagcatcttgagatgggggcattatcctggattatttaggtgggccctgaatgccatctcaagagtccttataagagagagacagagggagactagacacgcagagagaggagaaggccacgtgaagacagagctgaggatgctggcattgaagataaagcgatgcagccacaagccagggagtgtcagcagaagctggaggaggcaagaaacgtgttcctcccggggcctgcagaccccttggtctcaccctggtgacactgactttggacttctggcctccagagctgtaagattctaagccaccaaatatatggtgatttgttacggcagccgagagaaactaataggagagtggttagtggttcacgctacaccctggtctacaccggaagcctctctccctggcacatgatggtgtccccaggatccagctcagagccaggcacacagtggggcccaggagagacaaaaatgatgtgcagaagcaaatgggtggggtttgccacccacctcccttacctcccttgtctgtttagcaaagaggtctttcatgctggtgttttccaaattaggttgtgaccatgtgtgatcatgacatccaggcagagggctggcatttttccgaaaaagggtagaaaatgtcagagtatggtgtgtgtgtaggcagggtcagtattggtcactgacccttacactgcagtggcatttgtgaaataggtcagggtcactggtcacgttgtctaaggtgttatccgagctcgtttcacaaccaagagaattaaagagcatagaccacccaaaaggtgaggttggagcgaaagtttaataagcaaaagaagaaagctctccacagaggagagggaagcccaagcgggttgccatttttacagttgattccaaaagctttttttttaaaaaattatttatttatttattttttattattatactttaagttttaggatacatgtgcacaacgtacaggtttgttacatgtgtttatatgtgccatgttggtgtgctgcacccagtaactcgtcctttagcattaggtatatctcctaatgctatccctcccccctccccccaccccacgacagtccccggtgtgtgatgttccccttcctgtgtccatgtgttctcattgttcaattcccacctatgagtgagaacatgcgttgtttggttttctgtccttgcgatagtttgctgagaatgatggtttccagcttcatccatgtccctacaaaggacatgaactcatcattgtttatggctgcatagtattccatggtgtatatgtgccacattttcttaatccagtctatcattgttggacatttgggttggttccaagtctttactattgtgaatagtgccgcaataaacatatgtgtgcatgtgtctttatagcagcatgatttataatcctttgggtatatacccagtaataggatggctgggtcaaatggtatttctagttctagatccctgaggaatcaccacaccgacttccacaatggttgaactagtttacagtcccaccaacagtgtaaaagtgttcctttttctccacatcctctccagcacctgttctttcctgactttttaatgatcgccgttctaactggtgtgagacggtatctcattgtgattttgatttgcatttctctgatggccagtgatgatgagcatttttcatgtgttttttggctgcataaatgtcttcttttgagaagtgtctattcatatccttcgcccactttttgatggggttgtttgtttttttcttgtacatttgtttgagttcattgtagattctggatattagccatttgtcagatgagtaggctgcaaaaattttctcccattctgtaggttgcctgttcactctgatggttaaactaaagagcttctgcacagcaaaagacaccaaaagcttttataagaaactcctttcatctctgtagctgtttgagtatcttatctgtaaagctatctgcataactctccgttatctatgtagttgtgggtacgtctttaggcaagcacaaagctccgcttctcttgtttctgtaaccgtgggtttgttttaggtaagctccgcccctccccgtgcaagttcccacagagaccaccatgtacgtgcctgaaaaggggagggaacttttcctgggagcctgtcagtcacgcaaagaacaaaaggcttctgtgctgggcagcttgagttttccccaggctgctctattgttgcctgtagctgtgatttttcaggcaggctgctcctctgaggaccacccttaactgtctacctaactggtttttccttttcttctcctcatttgtatttatgtatcagtgtattatgtatttatatacacttggagatacagtaaaatgtacctctcactgtgggttaccataaatactgtaaatttgagaaacactctttcaggcctgagaggagcagtgacaacagtagggatgatcaagtcagatgtccctggtacccaggaatggctggatgagagaaggagacagggtgacctgcccctgcctacaaactctaacccagttctgtccctggagctgtgtgaccccggacaaggccctgcccctttccaggctgtcgttgtcctcatccagcctgggagagggttggcgctgaggcccccaccttcttgcctgtttcctcctgaccccaccccttcccctcctgctgggcagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctcaacatcta

SEQ ID NO: 129410 - DNA, 575 bp, Homo sapiens
  Payload ID: 5310
  Gene Symbol: ETFB
  Gene Name: electron-transfer-flavoprotein, beta polypeptide
  ENST ID: ENST00000596253
  CDS Start-End: 41-575
gagggtgcgggctgaccctgtaagtggctgcggcgggaagatggcggagctgcgcgtgctcgtagctgtcaagagggtcatcgactacgccgtgaagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgcccc

SEQ ID NO: 129411 - DNA, 1903 bp, Homo sapiens
  Payload ID: 5311
  Gene Symbol: ETFDH
  Gene Name: electron-transferring-flavoprotein dehydrogenase
  Uniprot ID: Q16134
  ENST ID: ENST00000307738
  CDS Start-End: 119-1831
agagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctgggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcagtctataccaaaactcacctttcctggtggtttactaattggttgtagtcctggttttatgaatgttcccaagatcaaaggtactcacacagcaatgaaaagtggaattttagcagcagaatctatttttaatcaactaactagtgaaaatctccaatcaaagacaataggactccatgtaactgaatatgaggacaatttgaagaactcatgggtatggaaagagctatattctgttagaaatataagaccgtcctgccacggagtactgggtgtatatggagggatgatttacactggaatcttttactggatattgagaggaatggagccgtggactctgaaacataaaggttctgactttgaacggctcaagccagccaaggattgcacacctattgagtatccaaaacccgatggacagatcagttttgacctcttgtcatctgtggctctgagtggtactaatcatgaacatgaccagccggcacacttaaccttaagggatgacagtatacctgtaaatagaaatctgtcgatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaaactgcagctagccagtttctttcaagtatggcaagctaacgttaaaatgtttagagattaacagatttcaga

SEQ ID NO: 129412 - DNA, 767 bp, Homo sapiens
  Payload ID: 5311
  Gene Symbol: ETFDH
  Gene Name: electron-transferring-flavoprotein dehydrogenase
  ENST ID: ENST00000507475
  CDS Start-End: 275-767
gcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctgggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatc

SEQ ID NO: 129413 - DNA, 446 bp, Homo sapiens
  Payload ID: 5311
  Gene Symbol: ETFDH
  Gene Name: electron-transferring-flavoprotein dehydrogenase
  ENST ID: ENST00000512251
  CDS Start-End: 333-446
gtgctgtgggattcgcggacccctctggccgcgctgtggctgtttcaccgctccccggctgggacttggagtcccttatctttccctggtttggtacatgacccggaagcctcggctggccgttgcgtcatccatggcgccggcgcagagcgagaaggaggtgggaacgccgtgaagcaagagcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctggatggtcttcaacttctactgtgcctcgaattactacccattatactatttatccccgggataaggacaagagatgggaag

SEQ ID NO: 129414 - DNA, 3282 bp, Homo sapiens
  Payload ID: 5311
  Gene Symbol: ETFDH
  Gene Name: electron-transferring-flavoprotein dehydrogenase
  Uniprot ID: Q16134
  ENST ID: ENST00000511912
  CDS Start-End: 333-2186
gtgctgtgggattcgcggacccctctggccgcgctgtggctgtttcaccgctccccggctgggacttggagtcccttatctttccctggtttggtacatgacccggaagcctcggctggccgttgcgtcatccatggcgccggcgcagagcgagaaggaggtgggaacgccgtgaagcaagagcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctggcatatcagtgctttcatgccttaaaaattaagaaaaattatctacctctatgtgctacaagatggtcttcaacttctactgtgcctcgaattactacccattatactatttatccccgggataaggacaagagatgggaaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcagtctataccaaaactcacctttcctggtggtttactaattggttgtagtcctggttttatgaatgttcccaagatcaaaggtactcacacagcaatgaaaagtggaattttagcagcagaatctatttttaatcaactaactagtgaaaatctccaatcaaagacaataggactccatgtaactgaatatgaggacaatttgaagaactcatgggtatggaaagagctatattctgttagaaatataagaccgtcctgccacggagtactgggtgtatatggagggatgatttacactggaatcttttactggatattgagaggaatggagccgtggactctgaaacataaaggttctgactttgaacggctcaagccagccaaggattgcacacctattgagtatccaaaacccgatggacagatcagttttgacctcttgtcatctgtggctctgagtggtactaatcatgaacatgaccagccggcacacttaaccttaagggatgacagtatacctgtaaatagaaatctgtcgatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaaactgcagctagccagtttctttcaagtatggcaagctaacgttaaaatgtttagagattaacagatttcagaatgtctttctgcatattactgaacagaatagtcacaaaatgattatcaaataaaaattttatactatatgtaagattgtcccataaagaaattacgggtattgcttttaaataacctttataagaatgcagcatcttcctacctcttcagttcttcagagattcagtaccaagagcaaaattcactactggactttacatttgacttgccaaagttaagtaatcaaatataaaaatgaatatatattctagactaaagttttattgaaacacagccatacccattggttacacattgtctatggctaattttgaattacaactgtgcaggtgagtgggtgtgacattacatggtctacaaagcctaaaaactttatgatctggcccttgcagaagaagtatgcccatccctgaacaagtttgtgtgtgtgtgtgtgtgtgtgtgtgtgtgtgtgtgtgtattatctataagtatgaaaacctagcatcatccaccatggatacatcaaagaatcgaaggaaacaatatacaaacttaagctctcatctctttattcaataagatgtgtctttacaagtttaaaaagactggacaccattattttttatgaataatgcacataaccattttaaaaaacattttacttggccgggcacggtggctcacacctgtaatcccagcactttgggaggccaaggcggggtggatcacaaggtcaggagttcaagaccaacgtgacgtgaccaatatggtgaaaccccatctctactaaaaatacaaaaattagctgggcgtggtggcacgtgcctgtaatcccagctacttgggaagctgaggcaggagaattgcttgaacccgggaggcagaggatgcagtgagccgagattgcgccaccgcactccagcctgggtgacagagcaagactccatctcaaagaaacaaacaaaaccactttacttactgtattgtgacatgtttattaagcatgaacccctatcagtactcctaaactgtaaacagtaag

SEQ ID NO: 129415 - DNA, 1019 bp, Homo sapiens
  Payload ID: 5312
  Gene Symbol: ELOF1
  Gene Name: ELF1 homolog, elongation factor 1
  Uniprot ID: P60002
  ENST ID: ENST00000252445
  CDS Start-End: 65-316
gaagtcactatctcccgggtgaacggagctttcgcagctggagaaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgtgtgtgtgtgtgtgtagtgggtgtgcgtgtgggtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgctctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcacatcc

SEQ ID NO: 129416 - DNA, 1172 bp, Homo sapiens
  Payload ID: 5312
  Gene Symbol: ELOF1
  Gene Name: ELF1 homolog, elongation factor 1
  ENST ID: ENST00000587806
  CDS Start-End: 159-473
aggctcttaggctccacccggccctgaacagctggcttgtcttggagtctcttgtgccaccctccccaggaacagtggcttccttgtattggcgccagcgatgatgggccagctctgtgctaaacggagtcttgctctgttgcccaggctggagtgcaatggtgcgatctcggctcactgcagtctccgcctcttgggttcaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgtgtgtgtgtgtgtgtagtgggtgtgcgtgtgggtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgctctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcac

SEQ ID NO: 129417 - DNA, 585 bp, Homo sapiens
  Payload ID: 5312
  Gene Symbol: ELOF1
  Gene Name: ELF1 homolog, elongation factor 1
  ENST ID: ENST00000593077
  CDS Start-End: 542-585
actatctcccgggtgaacggagctttcgcagctggagaagctcccaggatccatccaaacacccagaaccctcccacctgtccctcctctctccctcacctgccaggggacggacagctgccctgagccttcacacagtgttcctctactcagaagtgcctgtccccacttctctgccctgcagtctgtcatctggatcgaggccatcagataacctgagtgtcactcctcctggatggtacttacatgtcctttgccaagaggagcagccagaataaaatcaccagttcctaggctcttaggctccacccggccctgaacagctggcttgtcttggagtctcttgtgccaccctccccaggaacagtggcttccttgtattggcgccagcgatgatgggccagctctgtgctaagtacttaacttaccattcctggtgtcagccccacaagtctcctctgagatagcaaccttatttcgactttttttttttttttttttttgagacggagtcttgctctgttgcccaggctggagtgcaatggtgcgatctcggctcactgcagtctccgcctcttgggttca

SEQ ID NO: 129418 - DNA, 899 bp, Homo sapiens
  Payload ID: 5312
  Gene Symbol: ELOF1
  Gene Name: ELF1 homolog, elongation factor 1
  ENST ID: ENST00000591912
  CDS Start-End: 330-692
aggggacggacagctgccctgagccttcacacagtgttcctctactcagaagtgcctgtccccacttctctgccctgcagtctgtcatctggatcgaggccatcagataacctgagtgtcactcctcctggatggtacttacatgtcctttgccaagaggagcagccagaataaaatcaccagttcctaggctcttaggctccacccggccctgaacagctggcttgtcttggagtctcttgtgccaccctccccaggaacagtggcttccttgtattggcgccagcgatgatgggccagctctgtgctaagctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtgtatccttggaaacctgggctttttccagagggtggggagggggctggagtccggaccctgctcatctggcccactgtgtgccctggtgcagggccaaagccgtccagaggaacaggtgccacctagtgatttctgtggggtgagaagatgcagggcagggttccaatgccaatgatcgcccttgacctaagtggcccagatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtg

SEQ ID NO: 129419 - DNA, 743 bp, Homo sapiens
  Payload ID: 5312
  Gene Symbol: ELOF1
  Gene Name: ELF1 homolog, elongation factor 1
  ENST ID: ENST00000589171
  CDS Start-End: 198-428
ggactggaagttcctctactccgtgcgtttacggggtcctggaggaggctcctgggacctcgagcttgggggaaagccggtcggggagactgactccccccgaccccatccttccaagcgcgactaccgggacgcctggctcctcccggcggccgtcgggaggcgatgccgaagctttagctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtcccagatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgtgtgtgtgtgtgtgtagtgggtgtgcgtgtgggtgtgggtgtgagtgagtgtgggtgtgtgtggctgcacgtgtcactggggtggccgtgagtgtgtgctcacaggtacgcggtggtgtcgggttcctgggcctgaggggc

SEQ ID NO: 129420 - DNA, 585 bp, Homo sapiens
  Payload ID: 5312
  Gene Symbol: ELOF1
  Gene Name: ELF1 homolog, elongation factor 1
  Uniprot ID: P60002
  ENST ID: ENST00000590700
  CDS Start-End: 179-430
cccgggtgaacggagctttcgcagctggagaagggtttcatcctgttgcctaggctggagtgcagtgcctggatcataactctggatcatcactgaaacctgaaactcctgggctcaagcgatcctcccatctcagcctcccaagtagctgggactacaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgtgtgtgt

SEQ ID NO: 129421 - DNA, 679 bp, Homo sapiens
  Payload ID: 5312
  Gene Symbol: ELOF1
  Gene Name: ELF1 homolog, elongation factor 1
  ENST ID: ENST00000591674
  CDS Start-End: 192-464
caggatccatccaaacacccagaaccctcccacctgtccctcctctctccctcacctgccaggggacggacagctgccctgagccttcacacagtgttcctctactcagaagtgcctgtccccacttctctgccctgcagtctgtcatctggatcgaggccatcagataacctgagtgtcactcctcctggatggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgtgtgtgtgtgtgtgtagtgggtgtgcgtgtgggtgtgggtgtgagtgagtgtgggtgtgtgtggctg

SEQ ID NO: 129422 - DNA, 2154 bp, Homo sapiens
  Payload ID: 5312
  Gene Symbol: ELOF1
  Gene Name: ELF1 homolog, elongation factor 1
  ENST ID: ENST00000586683
  CDS Start-End: 59-403
actatctcccgggtgaacggagctttcgcagctggagaaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtccagcgcacatcccttgctgtccgtgatgtcttgggttctgcgtctgcctggtcaccagaagaaggagaggggacctgaggctctgacgttcgggaggtggcctggtggcccatgtgaccagcccttcaaaccacccagcgttttattcagtcagtaagcattcagggtggtggagcaggcagacatctggccaggtgtttacagcagtcacaataggaaatgggggaggtgagacagaacaggtggtcagaggaggcttctgggaggggcaggctgagacagtgacaccgtagggccacctctagccagacgctgacctctggccttcctgcgtcgccccagtgtcctgacagccactttgtggggcaggtgccaagctaaccccaagttcaaagatgaggaaacagaggctagaggtgaaggaggtcactggcccaagaccctacagccagaaagtggcacaggggggatttgaacccaggaaacgaggctccacagcttacagtctgacttcttgtgagcccagagtccaggctgagggaacagcttacaggccgttctggaggtagtgagtggaagagggacacgggagggaaacatgaaaggggcctttattcaagggtggtgaggactctcagaaggctggtgttggggcgggatgtgtgtggccgatggggagcacctgagggctgatgtccccttagctggtcgcaccggtgacaaggaccacaacacccagcaacctggggcagtgccagaccctccacctggcctcatgagcccgggtggcaggtgacctgtgcttcagagtcctcgttgctacagtgcaggggatgaaagcaccttcttcccggagccatgctgaggatggaagtgccaggcatggtttgagcggctctggggcccacccagggcactgacggatgtgaacagcggggggagacattgagctggcccggaagccctggctgccagactgggctgctgggtctggcctgtgcaccccctcaggcccactctgccatgacatgtcttccctggttatcccgccacctccaagatcccaggtaaggtctgctagccctggcaggagccggcacacatgcgcagagtggtggacaggcacctaggtttagggtgatggccctctgggatccagcaaaaagggggctcattcctctggcacccgaggcccttcctgccgcccgcccaccccagcctcacaggctaagtgctaatatggtgctgttttcccgaggaggcagggccctgggccaggcccggatcctcctcagcatagcttccccgcgccggcccagggggagcaggacttgcggtagccaggccaaaagcgcctggaatccggtttacgaggccccaggggctgcgtgcgtctgtgcgcgggtcttctggtgtctgcctccgcaggtctccacgttccagcctcaactcctgccctccctggggagaagacagctccgtgccgcgctcctcgcttctctgcctcctctcctccttggaatcctgatggttggggacctctccctcctcccggggataacagggtcccctctgaaatgtgaggaggttgaggccctggacacagccttttagagtcccgggttggcaggctcagccttaagacggctgagagcgggcggggcgcacagaattaaccgtgccctatggtgccctgtgccagtcagtaaagggccattgccttggctcagaagtgcccctctccctgtcccctttcccctccccacagtctggggctaaagggttcaccctgcccacagggcccaccaggacccctacttgtcatcctttctctattgatgcctggtctttaccagcgattaaacatgtagaacatcaccccatctgggggtgtcatttcatgaccac

SEQ ID NO: 129423 - DNA, 658 bp, Homo sapiens
  Payload ID: 5312
  Gene Symbol: ELOF1
  Gene Name: ELF1 homolog, elongation factor 1
  Uniprot ID: P60002
  ENST ID: ENST00000586120
  CDS Start-End: 225-476
ttttaattttttttttttagagatgaggcctcactatgttgcccaggctggtatccaggtcctggcatcaagtaatcctctcaccttagcttcccaaagtgctggctgggatcacaggtgtgagccaccatgcctggccttgtctctgttttatagacgaggaaactgtggcacaaagagcttaaataacctgcccaggtcacgcagctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgtgtgtgtgtgtgtgtagtgggtgtgcgtgtgggt

SEQ ID NO: 129424 - DNA, 2695 bp, Homo sapiens
  Payload ID: 5313
  Gene Symbol: ELK1
  Gene Name: ELK1, member of ETS oncogene family
  Uniprot ID: P19419
  ENST ID: ENST00000247161
  CDS Start-End: 101-1387
cgcgtatggagcccccgccccccggagctgccaacattgccaacgccaccgccacgctacacacaggtacccctgggatggcgtgagcactcccccagcgatggacccatctgtgacgctgtggcagtttctgctgcagctgctgagagagcaaggcaatggccacatcatctcctggacttcacgggatggtggtgaattcaagctggtggatgcagaggaggtggcccggctgtgggggctacgcaagaacaagaccaacatgaattacgacaagctcagccgggccttgcggtactactatgacaagaacatcatccgcaaggtgagcggccagaagttcgtctacaagtttgtgtcctaccctgaggtcgcagggtgctccactgaggactgcccgccccagccagaggtgtctgttacctccaccatgccaaatgtggcccctgctgctatacatgccgccccaggggacactgtctctggaaagccaggcacacccaagggtgcaggaatggcaggcccaggcggtttggcacgcagcagccggaacgagtacatgcgctcgggcctctattccaccttcaccatccagtctctgcagccgcagccaccccctcatcctcggcctgctgtggtgctccccagtgcagctcctgcaggggcagcagcgcccccctcggggagcaggagcaccagtccaagccccttggaggcctgtctggaggctgaagaggccggcttgcctctgcaggtcatcctgaccccgcccgaggccccaaacctgaaatcggaagagcttaatgtggagccgggtttgggccgggctttgcccccagaagtgaaagtagaagggcccaaggaagagttggaagttgcgggggagagagggtttgtgccagaaaccaccaaggccgagccagaagtccctccacaggagggcgtgccagcccggctgcccgcggttgttatggacaccgcagggcaggcgggcggccatgcggcttccagccctgagatctcccagccgcagaagggccggaagccccgggacctagagcttccactcagcccgagcctgctaggtgggccgggacccgaacggaccccaggatcgggaagtggctccggcctccaggctccggggccggcgctgaccccatccctgcttcctacgcatacattgaccccggtgctgctgacacccagctcgctgcctcctagcattcacttctggagcaccctgagtcccattgcgccccgtagcccggccaagctctccttccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtcccttttgttcttccccctgagaagccattcctttgtctgccaacctccctggggtcctgcctgtttcctcccaatggagggtttttttggggggtggtccccgtctggggggcccctccagccagtactccaggtctccctgtctctcccccgctgccattttgatagtataatctatttttaaatggggcttttcaataggggagagggagtcatctcttcctatatttggtggggtgggtgggaaggaagggatttgggggggaatcttcctgccgcctcccccactccaagtgtttatttttgataccaaacatgaattttcagttccctccctcccagccccccaatttcctgcgggcgggtacaaaggaccctttcaatgtccctggagttgggagggaggaatgggggacataaagcctgtcctgtctctattctaggcaagagagagtgggttcaaaagactcctgggctcacctgttagcgctggcccagcccaggccttgggacctgggggttggtgatttgggggacagtgctacactcgtctccactgtttgttttacttccccaaaatggaccttttttttttctaaagagtcccagagaatggggaattgttcctgtaaatatatatttttcaaagtga

SEQ ID NO: 129425 - DNA, 736 bp, Homo sapiens
  Payload ID: 5313
  Gene Symbol: ELK1
  Gene Name: ELK1, member of ETS oncogene family
  Uniprot ID: P19419
  ENST ID: ENST00000343894
  CDS Start-End: 310-597
gagctgtagggaaacgcaggggcggcttctaggtgctgccgccgccaccgccaccaccacctccaccgccgcctcggaacccaggcctggggggcggtggggccgcgtatggagcccccgccccccggagctgccaacattgccaacgccaccgccacgctacacacagcctcaactttcaggagacccgtccgtggccttatttattccacccttcctgtacatcgtagcgaatcaatccgtggcgccgcactcctccgcatccctctttaacagtacccctgggatggcgtgagcactcccccagcgatggacccatctgtgacgctgtggcagtttctgctgcagctgctgagagagcaaggcaatggccacatcatctcctggacttcacgggatggtggtgaattcaagctggtggatgcagaggaggtggcccggctgtgggggctacgcaagaacaagaccaacatgaattacgacaagctcagccgggccttgcggtactactatgacaagaacatcatccgcaaggtgagcggccagaagttcgtctacaagtttgtgtcctaccctgagtcccattgcgccccgtagcccggccaagctctccttccagtttccatccagtggcagcgcccaggtgcacatcccttctatcagcgtggatggcctctcgacccccgtggtgctctccccagggccccagaagccatgactactaccaccaccacca

SEQ ID NO: 129426 - DNA, 2258 bp, Homo sapiens
  Payload ID: 5313
  Gene Symbol: ELK1
  Gene Name: ELK1, member of ETS oncogene family
  Uniprot ID: P19419
  ENST ID: ENST00000376983
  CDS Start-End: 310-1596
gagctgtagggaaacgcaggggcggcttctaggtgctgccgccgccaccgccaccaccacctccaccgccgcctcggaacccaggcctggggggcggtggggccgcgtatggagcccccgccccccggagctgccaacattgccaacgccaccgccacgctacacacagcctcaactttcaggagacccgtccgtggccttatttattccacccttcctgtacatcgtagcgaatcaatccgtggcgccgcactcctccgcatccctctttaacagtacccctgggatggcgtgagcactcccccagcgatggacccatctgtgacgctgtggcagtttctgctgcagctgctgagagagcaaggcaatggccacatcatctcctggacttcacgggatggtggtgaattcaagctggtggatgcagaggaggtggcccggctgtgggggctacgcaagaacaagaccaacatgaattacgacaagctcagccgggccttgcggtactactatgacaagaacatcatccgcaaggtgagcggccagaagttcgtctacaagtttgtgtcctaccctgaggtcgcagggtgctccactgaggactgcccgccccagccagaggtgtctgttacctccaccatgccaaatgtggcccctgctgctatacatgccgccccaggggacactgtctctggaaagccaggcacacccaagggtgcaggaatggcaggcccaggcggtttggcacgcagcagccggaacgagtacatgcgctcgggcctctattccaccttcaccatccagtctctgcagccgcagccaccccctcatcctcggcctgctgtggtgctccccagtgcagctcctgcaggggcagcagcgcccccctcggggagcaggagcaccagtccaagccccttggaggcctgtctggaggctgaagaggccggcttgcctctgcaggtcatcctgaccccgcccgaggccccaaacctgaaatcggaagagcttaatgtggagccgggtttgggccgggctttgcccccagaagtgaaagtagaagggcccaaggaagagttggaagttgcgggggagagagggtttgtgccagaaaccaccaaggccgagccagaagtccctccacaggagggcgtgccagcccggctgcccgcggttgttatggacaccgcagggcaggcgggcggccatgcggcttccagccctgagatctcccagccgcagaagggccggaagccccgggacctagagcttccactcagcccgagcctgctaggtgggccgggacccgaacggaccccaggatcgggaagtggctccggcctccaggctccggggccggcgctgaccccatccctgcttcctacgcatacattgaccccggtgctgctgacacccagctcgctgcctcctagcattcacttctggagcaccctgagtcccattgcgccccgtagcccggccaagctctccttccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtccctttt

SEQ ID NO: 129427 - DNA, 4205 bp, Homo sapiens
  Payload ID: 5314
  Gene Symbol: ELK3
  Gene Name: ELK3, ETS-domain protein (SRF accessory protein 2)
  Uniprot ID: P41970
  ENST ID: ENST00000228741
  CDS Start-End: 327-1550
tgggcggccagccccggcgcacagccgcggccggggcgcgcggcgcggggcggaaaagcctgtttacacagactgcacaccgcctggggaataatgcagtaaaggaagtgagccggctcggcctgactgctccaacttcctgctctcacacacaccagaggggaaaaaaaaagaggagcgagagaaagaaaaaaagggggaaaaatcaggatctcattacaagagccacagaccgtctgcagacgcctgtcagcatggaaagtcgggggctttcgcccgggtcctcctagaaattccccccgaagaagactcccccacatctgggtatggagagtgcaatcacgctgtggcagttcctgttgcagttgctgctggatcagaaacatgagcatttgatctgctggacctcgaacgatggtgaattcaagctcctcaaagcagaagaagtggccaagctgtggggactccgaaaaaacaaaacaaatatgaactatgataagctgagcagagccctgcgatactattatgacaagaacatcatcaagaaggtgatcgggcagaagtttgtgtacaagtttgtctctttcccggagatcctgaagatggatcctcacgcggtggagatcagccgggagagccttctgctgcaggacagcgactgcaaggcgtctccggagggccgcgaggcccacaaacacggcctggccgccctcagaagcacgagccgcaacgaatacatccactcaggcctgtactcgtccttcaccattaattccctgcagaacccaccagacgccttcaaggccatcaagacggagaagctggaggagccgcccgaagacagcccccccgtggaagaagtcaggactgtgatcaggtttgtgaccaataaaaccgacaagcacgtcaccaggccggtggtgtccctgccttccacgtcagaggctgcggcggcgtccgccttcctggcctcgtccgtctcggccaagatctcctctttaatgttgccaaacgctgccagtatttcatccgcctcacccttctcatctcggtccccgtccctgtcccccaactcacccctcccttctgaacacagaagcctcttcctggaggccgcctgccatgactccgattccctggagcccttgaacctgtcatcgggctccaagaccaagtctccatctcttcccccaaaggccaaaaaacccaaaggcttggaaatctcagcgcccccgctggtgctctccggcaccgacatcggctccatcgccctcaacagcccagccctcccctcgggatccctcaccccagccttcttcaccgcacagacaccaaatggattgcttctgactccgagtccactgctctccagcatacatttctggagcagccttagtccagttgctccgctgagtcctgccaggctgcaagggccaagcacgctgttccagttccccacactgcttaatggccacatgccagtgccaatccccagtctggacagagctgcttctccagtactgctttcttcaaactctcagaaatcctgatgacgtctggccacaattaaggactcattaactgatgaaacaaatttgtccccacgggctagtttacctgtgtcgtgagaaggacattgtgaaactcttgttaatttggtttgcacttttcataacatggatagtctagatttatgttagcattttaaaaactgtttttgatatattcaagtatatatgaaaatctgtttggcattaagtgaattttaatgtttttgtttttatatccttttagctcttaagtgttgaacactgttgacagtgaagaacttttcttaatggttttcagtataactaataaggatgtgaagcttttttctctttagttctgagtatgctaaactgtgtgcttatatagactataaccagttgtgccttccttcgcatttaatgtaaatgaatgatttatatattttttagtattaagaggaaatgtttgaaagatgaaaattagtatcaaacagctctctagtagaatttcattatttttcaccagtgggcaatatgaaagcatatatcacgttttgttttactttcaattgtataagaattgccttagaacctcttttgaactgaaattcagtaaatgtccaagtaatgtttttataataaactaagccatatttagacaataaacattgataaaagaaaatgttctaaagtacattttcaaaagaatggaccttgaaaggctagcctccttagctgtttacagtatcttatcttttagatgcctcccagacaaaaatctgagatggaaaagctacatcaagttcatgctattccaggcccaagaatatctcctaggttagcatattcttatttcaaaaaattagccctggttttctcagttttccatagggaatcccgaccatctgatatatttactgtgtcagtataagtaagttggggttcccctggaactataattaacatttaaaaaatctaatgctttagaagaagctcacagagtggtgatgaacccaaacaacaaagaaaccatttttaacactaggtatcttcatcagtataggtaggtgttcacaatttttgatggatcaaaaacttgctgtaatacaaatagagagtggaggtactaaaggccttgcttgtggaaactgagagaggatacactgctttatgtattactaaagttaggggagaatgaaggaaatctgacagatgaaaaattctacaggaacctcatcatcgtggaactgaactgatgataacttggaacactccagtaaattctgttgtgtaatgtaatttggagcagtgataatacagacatattttctgttccatcagaaaatcagcaggcaccagtccaaaggtaccacacctgtacatgaagaaggaaagttctaatacaagaaaactgaaaagcaccaagctttaaattcaagattaattacaatccttaactataagtgatgataaaaactaacttgaaatgtgactaaataactgatccaaactgggcattaagtggcaggattatgagaaaggataaaaaaagagatttgagaaaacacatttcttgaattttcagaaaaaaatctagactattgctttgacacttagaaattctgaggtttttcaattggaattgagcatctctgtatgtggggatgtgggcccttatcaagggataaaaatccaaacactctaacatgcctccttgactgtaaagtaatgacactggttccaaaattcacaaataatagacactactgtccccccacccccaccccataggctaagaataattctgtaccagaataaaaggagctggtccagggaactgatatttactgaacatacaaagttagtgctagaaggggcctttgagaatgcttcccgccacctgtttccagctcaagacaggtgcacagcagaagctgggagttgcctatggctgcacagctcactgaaggtagaacaatgattggtgctcagtccaattctgtctcccccatgcctagctgttaagtaattactggttcaaaactacgtgttattagtaaaacaaacaaaacagataaagacagcatttaaaactgtgttgtcagataagagaacacatccaaaatgcatgattcttacaaactaaaggaagttaatgtgcaaaaatctcaaccaaaactactatttttagtatacttgtttacgtaaatgctgattggaaatatttaaatgactatagatctgattctttcttttcctttggaaactgggattaatgtatgctctagatccatttattagaaatgcaaaaatactacaattttttgatggatgaaaatactcctgtaacacaaacagagaactggaggaactgaagaataactcactcatatagctctgcctcattctgtgtgtgtgtgcatgtgtgtgttagcagaggtattttactcagaaaataggtttcaaagaacattaatgactttcttttcccttttatgtctgcttaatcagtgttaaactgctatgggaaaagttttatagaactatataacctgaatgttggtctctttgtacacatcttttctatgactgcaaatcttcactttatgtatcatttttactgtcatattatttttgttcaataaaaactttgtgataaaaggtgtttagaggtaa

SEQ ID NO: 129428 - DNA, 539 bp, Homo sapiens
  Payload ID: 5314
  Gene Symbol: ELK3
  Gene Name: ELK3, ETS-domain protein (SRF accessory protein 2)
  ENST ID: ENST00000547249
  CDS Start-End: 424-539
acagccgcggccggggcgcgcggcgcggggcggaaaagcctgtttacacagactgcacaccgcctggggaataatgcagtaaaggaagtgagccggctcggcctgactgctccaacttcctgctctcacacacaccagaggggaaaaaaaaagaggagcgagagaaagaaaaaaagggggaaaaatcaggatctcattacaagagccacagaccgtctgcagacgcctgtcagcatggaaagtcgggggctttcgcccgggtcctcctagaaattccccccgaagaagactcccccacatctggaagaccagtatggtgctgtgaaatgttgcaaaacatgacctgatgacaacccaaaacacttcatagaaaactatccaagaatgtgacttcctggagtagagtcttttttcactgagggtatggagagtgcaatcacgctgtggcagttcctgttgcagttgctgctggatcagaaacatgagcatttgatctgctggacctcgaacgatggtgaattcaagctcctcaaagcaga

SEQ ID NO: 129429 - DNA, 808 bp, Homo sapiens
  Payload ID: 5314
  Gene Symbol: ELK3
  Gene Name: ELK3, ETS-domain protein (SRF accessory protein 2)
  ENST ID: ENST00000547860
  CDS Start-End: 330-808
ccgtctgcagacgcctgtcagcatggaaagtcgggggctttcgcccgggtcctcctagaaattccccccgaagaagactcccccacatctggaagagattaaatgaagatgtgtgtgtgttgaagactgcatagtgcacactctgtgtggctaccggtgagccacgtggcgggatacaggactcaaagaagatcacactggagaagggagttcatgctctgttgcccaggctggggtgcagtgatgtgatcacagctcactgcagcctcaaactcctgggcttaagtgatcctcctgcctcagctccccaagtagctgggactacaggtatggagagtgcaatcacgctgtggcagttcctgttgcagttgctgctggatcagaaacatgagcatttgatctgctggacctcgaacgatggtgaattcaagctcctcaaagcagaagaagtggccaagctgtggggactccgaaaaaacaaaacaaatatgaactatgataagctgagcagagccctgcgatactattatgacaagaacatcatcaagaaggtgatcgggcagaagtttgtgtacaagtttgtctctttcccggagatcctgaagatggatcctcacgcggtggagatcagccgggagagccttctgctgcaggacagcgactgcaaggcgtctccggagggccgcgaggcccacaaacacggcctggccgccctcagaagcacgagccgcaacgaatacatccactcaggcctgtactcgtccttcaccattaattccctgcagaacccaccagacgccttcaaggc

SEQ ID NO: 129430 - DNA, 684 bp, Homo sapiens
  Payload ID: 5314
  Gene Symbol: ELK3
  Gene Name: ELK3, ETS-domain protein (SRF accessory protein 2)
  ENST ID: ENST00000549985
  CDS Start-End: 1-307
ccgcaacgaatacatccactcaggcctgtactcgtccttcaccattaattccctgcagaacccaccagacgccttcaaggccatcaagacggagaagctggaggagccgcccgaagacagcccccccgtggaagaagtcaggactgtgatcaggccaaaaaacccaaaggcttggaaatctcagcgcccccgctggtgctctccggcaccgacatcggctccatcgccctcaacagcccagccctcccctcgggatccctcaccccagccttcttcaccgcacagacaccaaatggattgcttctgactccgagtccactgctctccagcatacatttctggagcagccttagtccagttgctccgctgagtcctgccaggctgcaagggccaagcacgctgttccagttccccacactgcttaatggccacatgccagtgccaatccccagtctggacagagctgcttctccagtactgctttcttcaaactctcagaaatcctgatgacgtctggccacaattaaggactcattaactgatgaaacaaatttgtccccacgggctagtttacctgtgtcgtgagaaggacattgtgaaactcttgttaatttggtttgcacttttcataacatggatagtctagatttatgttagcattttaaaaactgtttttgatatatt

SEQ ID NO: 129431 - DNA, 1242 bp, Homo sapiens
  Payload ID: 5314
  Gene Symbol: ELK3
  Gene Name: ELK3, ETS-domain protein (SRF accessory protein 2)
  ENST ID: ENST00000552142
  CDS Start-End: 164-592
aaaaaaaaagaggagcgagagaaagaaaaaaagggggaaaaatcaggatctcattacaagagccacagaccgtctgcagacgcctgtcagcatggaaagtcgggggctttcgcccgggtcctcctagaaattccccccgaagaagactcccccacatctgggtatggagagtgcaatcacgctgtggcagttcctgttgcagttgctgctggatcagaaacatgagcatttgatctgctggacctcgaacgatggtgaattcaagctcctcaaagcagaagaagtggccaagctgtggggactccgaaaaaacaaaacaaatatgaactatgataagctgagcagagccctgcgatactattatgacaagacaccaaatggattgcttctgactccgagtccactgctctccagcatacatttctggagcagccttagtccagttgctccgctgagtcctgccaggctgcaagggccaagcacgctgttccagttccccacactgcttaatggccacatgccagtgccaatccccagtctggacagagctgcttctccagtactgctttcttcaaactctcagaaatcctgatgacgtctggccacaattaaggactcattaactgatgaaacaaatttgtccccacgggctagtttacctgtgtcgtgagaaggacattgtgaaactcttgttaatttggtttgcacttttcataacatggatagtctagatttatgttagcattttaaaaactgtttttgatatattcaagtatatatgaaaatctgtttggcattaagtgaattttaatgtttttgtttttatatccttttagctcttaagtgttgaacactgttgacagtgaagaacttttcttaatggttttcagtataactaataaggatgtgaagcttttttctctttagttctgagtatgctaaactgtgtgcttatatagactataaccagttgtgccttccttcgcatttaatgtaaatgaatgatttatatattttttagtattaagaggaaatgtttgaaagatgaaaattagtatcaaacagctctctagtagaatttcattatttttcaccagtgggcaatatgaaagcatatatcacgttttgttttactttcaattgtataagaattgccttagaacctcttttgaactgaaattcagtaaatgtccaagtaatgtttttataataaactaagccatatttagacaataaacattg

SEQ ID NO: 129432 - DNA, 2118 bp, Homo sapiens
  Payload ID: 5315
  Gene Symbol: ELK4
  Gene Name: ELK4, ETS-domain protein (SRF accessory protein 1)
  Uniprot ID: P28324
  ENST ID: ENST00000289703
  CDS Start-End: 341-1558
gcggccgcggagggcctggcaggccccgccgctgcaaggaacgccccgaacgcgcgcgcccggcgtgtagcggccccaagacccgcgccgccgctgccgcgtgcgggggcggggagggcggggcgccaggagccgcggcggcgggagatgcgggcggctgcgggcacccggcgggctcggcttggccgccgccgccttctacggctccgccgcgggggtcgcagcggctgccgcgccgtcctcgagtttccagcgtgaggaggaggctgagggcggagaggcgcatcgtgttcgaggcggagaccgagggggagccccgcgcgcggcgtcgctcattgctatggacagtgctatcaccctgtggcagttccttcttcagctcctgcagaagcctcagaacaagcacatgatctgttggacctctaatgatgggcagtttaagcttttgcaggcagaagaggtggctcgtctctgggggattcgcaagaacaagcctaacatgaattatgacaaactcagccgagccctcagatactattatgtaaagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactctggcttatattcttcatttactctcaactctttgaactcctccaatgtaaagcttttcaaattgataaagactgagaatccagccgagaaactggcagagaaaaaatctcctcaggagcccacaccatctgtcatcaaatttgtcacgacaccttccaaaaagccaccggttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacaccacccatttcgtccataccccctttgcaggaacctcccagaacaccttcaccaccactgagttctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtgatcacgagcagtgatccaagcccactgggaatactgagcccatctctccctacagcttctcttacaccagcatttttttcacaggtagcttgctcgctctttatggtgtcaccattgctttcatttatttgcccttttaagcaaatccagaatttatacactcaagtttgctttctgttacttaggtttgtcttagaaaggttatgtgtgactgtcatgtgaaagttaccccatttctcatcttaattaggattgctaaaatagaaagtttggagtattttcttaaaaaattcattgttctacaagtaaataaatattttgatttttctatttcctcctaaagaaagtacacacactctctcgctctctctcggtcttataaaactcgttggtgtcttataaaacaaacagtgataatctcaagttagaaaacagtaggtcctgagaaccataagaaaaatgactggtgtgatgttgagtaacaagttggtacagttactttagctatttattaacttgctcatctcatagaacattttagtagatttttcacacacctcattattaaaaaaaaacaaacatgctggtgtcttggttacccattattcctctgtacctgaattcaggttggtttttctatttggaaaagactttataaatgttggcttaaaaagaggttgagcaccagaatctcagaatttaccaccaaagaactcatccatgtaaccaaaaaccacttgtacccccaaaaactattgaaataaaaatttaaaaaattttaa

SEQ ID NO: 129433 - DNA, 10239 bp, Homo sapiens
  Payload ID: 5315
  Gene Symbol: ELK4
  Gene Name: ELK4, ETS-domain protein (SRF accessory protein 1)
  Uniprot ID: P28324
  ENST ID: ENST00000357992
  CDS Start-End: 341-1636
gcggccgcggagggcctggcaggccccgccgctgcaaggaacgccccgaacgcgcgcgcccggcgtgtagcggccccaagacccgcgccgccgctgccgcgtgcgggggcggggagggcggggcgccaggagccgcggcggcgggagatgcgggcggctgcgggcacccggcgggctcggcttggccgccgccgccttctacggctccgccgcgggggtcgcagcggctgccgcgccgtcctcgagtttccagcgtgaggaggaggctgagggcggagaggcgcatcgtgttcgaggcggagaccgagggggagccccgcgcgcggcgtcgctcattgctatggacagtgctatcaccctgtggcagttccttcttcagctcctgcagaagcctcagaacaagcacatgatctgttggacctctaatgatgggcagtttaagcttttgcaggcagaagaggtggctcgtctctgggggattcgcaagaacaagcctaacatgaattatgacaaactcagccgagccctcagatactattatgtaaagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactctggcttatattcttcatttactctcaactctttgaactcctccaatgtaaagcttttcaaattgataaagactgagaatccagccgagaaactggcagagaaaaaatctcctcaggagcccacaccatctgtcatcaaatttgtcacgacaccttccaaaaagccaccggttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacaccacccatttcgtccataccccctttgcaggaacctcccagaacaccttcaccaccactgagttctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtgatcacgagcagtgatccaagcccactgggaatactgagcccatctctccctacagcttctcttacaccagcatttttttcacagacacccatcatactgactccaagccccttgctctccagtatccacttctggagtactctcagtcctgttgctcccctaagtccagccagactgcaaggtgctaacacacttttccagtttccttctgtactgaacagtcatgggccattcactctgtctgggctggatggaccttccacccctggcccattttccccagacctacagaagacataacctatgcacttgtggaatgagagaaccgaggaacgaagaaacagacattcaacatgattgcatttgaagtgagcaattgatagttctacaatgctgataatagactattgtgatttttgccattccccattgaaaacatctttttaggattctctttgaataggactcaagttggactatatgtataaaaatgccttaattggagtctaaactccacctccctctgtcttttccttttctttttctttccttccttccttttcttttctcctttaaaaatattttgagctttgtgctgaagaagtttttggtgggctttagtgactgtgctttgcaaaagcaattaagaacaaagttactccttctggctattgggaccctttggccaggaaaaattatgcttagaatctattatttaaagaaatatttgtgaaatgaattggcatctttaggactaagtgtgctctgttgaatgacttaaagtgagctgttcctaagcagtggaagaagaagaatcattcctattcatacaaagtaagattggagcagtcatactggggagattgttttgtgtgaactataacgtgtaagcaactccatgaaaaggcatcttgtttacctttattcagggtggatctcttagccatatgtatgatcctgtctgaacctgtcaacagagcatggagctagtctatttcactatagaaagatttttagacctggggtttaagacagtttttggaacacctagtaagaatatgggacctcacatctagcacagaaatgctctttgccctctgggtggtatgattatatgcccatggaatacagcatgggaaatgatcacttttaggaggatgaacttggattttgaatatttgaaacatctctgagtaaaagattcgatcagataacttgaaacaacatgtagtggttttctcaattagaagataaccaagtgaaggacctgtctttttcctgttcattttacctcattttctactatacatttatcacctttcctttatgtttaaggttgttagaggttatgatagttttaaagatgcagttaggaaggtagaattcaaagtgaagcctccccagtcaggagcgaagatgtgcttatttcctttttttttttttttttttttttttgagacagagtcttgctctatcacccaggctggagtgcagtggcgcgatctcagctcactgtaagctccgcctcccgggttcaagcaattctcctgcctcagcctcctgagtagctgggactacaggcatgcgccactacgcctggctaatttttgtatttttagtagagacggggtttcaccatgttggccaggatggtcttgatctcttgaccttgtgatccgcccacctcagcctcccaaaggcgcaggctcagatgtgcttatttctttcaactttttttttttaaatggggaagagcagagttcatttgggaatgcttatacatagggattggattgttcatattagtagtaaaaaatgtaggccttattctctacattaccaaatttttaaaatattactatatggtaatcaatgccaggtacagatttgttggttccccaaactgaattgatatcagtatcacagtggagtcttttgaaaattaaagtccaggattaaattatatgttgtcaccattcaccaccactaccaccctcccccaccaatctctcccaccggttaaactcgtcttctaatcctgtagaatcacatgaactaaatgaagaagtaagaacttgaaggctcagactgacactgttacaaactagcatcttcagatgcatggtatttactttaaatgtgcttatatacagtgtagagaagctcttgtataagaagacatctatgctagctaacttagtagtagtagagggaacatattcagtgagctgcctttatatctgtagtgtcggagacttgttactggttcatttgtggttatcagttgaaggttctgttcctgagatgtgcaatagtagtgttgaaaggtattgtttaatagtgatggggaacagacatattggacttttttttccatattaaattatttagtttgcatgcctgtttgaaattggacctctcagcagcactttgaaatagttttaattaggttaacattttgtacattaaataagtagatatagatggttgatttaactagatgtgttaaattttgaaagcacaaaggtattttatctttttgaattaaaggagaaaagccattgatttgttttcacagacagtatttttaataattaactgtctcagcacagaggtaccttggaaccaagggcaccattgaaactcagttgaagcaacttcctagtaaaccattttagtgagtcctttttgcataaatctatagcctctcagaggtgtgaggctgtcacagattggtgatctgctatctctttgagatcaactaatttggagaagtgtgtgtgtgcgtatccttttttaagtcaaagtttacaaccttactgcaggtgtatgaggcagacagttctgtttatagactacctccttcctggaaaagtctcagcttcatattctgttgaatatatgcagaattcttagtgtgaaaggtgatgtaccacttcagatcagttttcactggagagacttgtaattggtagctgtagctcgtatccatccctagtcactttgccaggatgaatgctgttgggcagcagtagcctaagttacggaaggggagcagattgaatggggttttgagacatcttctctgataccttagctttccttctgctctggtcgctatccactcagtcgtgtgctagaaatgtttaacaaccaggatctctggggtgggggtgggggggagcgctgaatttgtagcatttgctgcaaatataaattataaataaaattctaatataaattagaattttatatcaaattctttgatataaattagttactcctcctgtggctgatttcaagctaccaccttagagttcagaaaggatgtgcacagttggctcagagccagtgctggcaaaccattgcatttactccacccaagagtggattttcacataatttctaaaataattttttcttatttatatactgacttttcaaaatacaaaattaaaatatcatgtctgacttcagtgatctttttctttttctttttttagaaatgagatctttcagtaatcctttaatttaattttttagagatggagtcttggtgtgttacccagggtggactcaaactcccgggctcaagtgatcctcctgcctcagcctcctgcatagctgggctacaggcatgcaccaccacacctggcttagtaatccttctttattaatggtttgtcacagtacgtttgtgatgttatattgctcatggcatactttatgtgttcgaacaaaggtggaaatttccattgatttttttttttttaaatgtatgcacaaacaatctggattttgaggagtacggtcaggaaaaaaaaaaaagaattagaggcccttgaaaggtcaaccgtaagcttcttagagttaaaatatgagtttaattttttcccacattttgacagttgaaattttgatagggacagtaaacctatgagcctctattaggctactggattttttttaactggaaaattccttgaagatttacatactatattacagattttaaaagtcaagactgacttaagtaaatcagaggtttggaattctggagctgtaactccaggctgttgatagtatcacttcagttccattcacccctgcattgtgtgacgtccagtctgacaacattgtttcatcctgatctgactttctactatgattcttaagttcttaaaggtgtccttttatgtttttggtgaatgtaagcacatttagagccactcagtaccacttctcaatacctctgaagcagtggttcagaaaaggagtgtccagcctttttgaacacacaaattgatcagtaagagttattgaacataaaaactttccctattaaaaattcatatgggtatatgttaaattatataccgctataccaaagtaatatgtgtgttataaaaaaatacacaaaaattgaagtgaaggatggcataaaaagtaattcttgagtagcagttatagtattttcttcccacaccccagttggttgtcttgtgcaccctccagaagcacacgcttttcctaaagactgctgactcaggatattctcattctaatctccaaacatatatgatgctctcttatgatatatggagaaatcctagagatttggagtttttcaggagagcttattgtcaacttttgaaatttcacattaattctttttgataaattcccaaataataatccattaccacatgttttccacagctttattcctattactttcgtcagcctgttgtctcttatcttcatgttaggtatgactctatttttattttactagtctgctcacagacttctttgggacttatgttatattttaccaacaaatttagaattatttcaagttgctttatgttaaaatatataacaagttacattttcttgctgcattaataagtttttgatttttaaaatctgatatttcagcaactaaaggaatacttttctttataggtctgttctgtttttaacctcattgactgtatatgttttatttacccgtgccaggagtctagaatcgtgcttaggtgccattcttaggtatgaaaacaagtttggagaccaatgcaggtctctgtgcagaaatctggggctctaaatgaattaccaaaccaataggaaagttaaaatactactcatgatgtagtgtgtcatctgaagctatgatagaatatattatttctaaaatagtattgagaagttaattgttcagtccatagtagtgtaagtgaagtgtggaggtcagccatagttgtctttcttcagcaggtactctaaccagagactgggttctgtggaaaatagaattatattcttggtttgggatcaacaaatgttttgttattgttttaatgttgctggcattgcctgaaacaaagtgccctgttattcctcttatgtcatcagaactctgcttactgaagttgaagtttaatcttaggatctagaattcttgtggttggtcgtgtattaagaaaagaaggtggtttgattttatttcttgtacttggtggaacctgttactatacaagtcatgttttgacctgtaagccgagcaaatctgaaaggtgaatcgttaatggtagtataattgtttcatttgaaactgtcagtttcttcaagtcacttctctgaaaaaaattatgatagattgatagcctgccagaaaatagcaatttctaaggtgctgccatccacacttacttattgtgaaatatgaaaatccagagtggtttgtatgagaggggaaatactggctctaagctttctacagaaaacaggaaattcatgctgttgttgacataattttaaaggaaacttttaacaagaaaattcatgagggatacaatcaaacatagttaatctcttgagtgctaatcatttgagtatagtccacatcaggaagttttatgaggttgaaaactttactttgaaatatttaattgggagactagaccatttctttttccaagtcattctgatttattgtcctagtaaatgtatgtgtatgcatatatactgatgtattgactgaatgtgtgtgtgtgtgtgtgtgcgcgtgtaaatctgttttcatagggaacatacattgatggctcctagtctattttatactaaaacttaaaaaaatttgctgcactttgcagttgccactttttaaaagattaatgctttgcacatttcagtaggccttaaagatgaattgctcaccaacattttagaaatacactgcttacatgtgacatactctaaacaaagtcatagtaaactgttctcttaggttcatgtattattgagcaaataaggatgtcctttcttaaaatttctacatttatgtttgcttttgtgtaaaatctttattagtttgtaagtttctcaaagaggaggtttatactggaagcagtatttctaaagtacagagattcgaccatggattgaatacagtagtggaggaatgctggtattgtggcctaatttatccttttaaactgtatgtcattagtattagccaaaacctcagagtggagtgtcttgggctgaatgatcttctcaactttgccttgtttcccatctcataaaggctccttctggttcttttcccttccaaggattgtgagtcatgctcacataggcctgggatcttctggatggggtcggggaggaggtgggggtttcctgtggctggcccagagttctagccaatggaatcattcaagaatgcctaaagttcaggggtgggaatgccatatattggtgttaatcacttggcactttcttgggcaccaatattagcactgtttcatttttaataactggaagcacttaatgattattttgtttgtttaatttcaacttaaggatattgagggtcagagaagtaaggtttatttcttgtttatgttttctggaatttatagggtgtttgtagaagggataaatgggttacctaatgagccattcttctaggctctgtaaggtatgcccttttggctaggatattttaaaataatttgcaagcttttaatattgtgctttgtagaaatttacgatttttaaaaataatttgcaattgatagattacacttaaatttataaagtatccaattttaagtttcttttctgtttggtcattgttgcttattgtctattgtgtaggggacacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaatga

SEQ ID NO: 129434 - DNA, 2535 bp, Homo sapiens
  Payload ID: 5315
  Gene Symbol: ELK4
  Gene Name: ELK4, ETS-domain protein (SRF accessory protein 1)
  Uniprot ID: P28324
  ENST ID: ENST00000616704
  CDS Start-End: 272-1567
gcggccccaagacccgcgccgccgctgccgcgtgcgggggcggggagggcggggcgccaggagccgcggcggcgggagatgcgggcggctgcgggcacccggcgggctcggcttggccgccgccgccttctacggctccgccgcgggggtcgcagcggctgccgcgccgtcctcgagtttccagcgtgaggaggaggctgagggcggagaggcgcatcgtgttcgaggcggagaccgagggggagccccgcgcgcggcgtcgctcattgctatggacagtgctatcaccctgtggcagttccttcttcagctcctgcagaagcctcagaacaagcacatgatctgttggacctctaatgatgggcagtttaagcttttgcaggcagaagaggtggctcgtctctgggggattcgcaagaacaagcctaacatgaattatgacaaactcagccgagccctcagatactattatgtaaagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactctggcttatattcttcatttactctcaactctttgaactcctccaatgtaaagcttttcaaattgataaagactgagaatccagccgagaaactggcagagaaaaaatctcctcaggagcccacaccatctgtcatcaaatttgtcacgacaccttccaaaaagccaccggttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacaccacccatttcgtccataccccctttgcaggaacctcccagaacaccttcaccaccactgagttctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtgatcacgagcagtgatccaagcccactgggaatactgagcccatctctccctacagcttctcttacaccagcatttttttcacagacacccatcatactgactccaagccccttgctctccagtatccacttctggagtactctcagtcctgttgctcccctaagtccagccagactgcaaggtgctaacacacttttccagtttccttctgtactgaacagtcatgggccattcactctgtctgggctggatggaccttccacccctggcccattttccccagacctacagaagacataacctatgcacttgtggaatgagagaaccgaggaacgaagaaacagacattcaacatgattgcatttgaatgaatccgatgtgcctgatgggttagatttccatatacaagtagcagaggaaaatctgggaacagggtgattccacaggattctgaaatgtccaaattcctgaaaggaagatgaggaagaaagtcctacttgtgtaactgagaagcgtgtggtaatgatctcaaacccagagtatggtccatgcatgaggtgacaaatggagtgaagcgcgcggctgtctccttccttcccatctgggtatctggacagctcttaccaacagtctgaaccagggaagaagataacttgagaagccagggaggacagagtctccgcctgggcaccttctcttaagaactggctttgcacacagccgatgcagtccctgggcactttgaaagcagtgggcaaaagggcaggttacactaaagcaagtcccagatgtcacatcatttcaatgaggagggtatggtgagatgcagctcttcccctccctccagcagggcaaaagaggaggaaaggagaatggagtcacaatgagggagattttggaggccggaagatctagatgtgaggtcctctctgtcagtttctggaagtgtgactgacctagggtccccacataccgaaccaaccagcatctgcagcaccatctcgccaactcctgcccctgtcaccagcactgtggttgcacagcctaacaaaaagagaaggtttggtttggtaaaagcaagttaaggagacagaagccagcattacaatccaggttgctggccaggcacagtggcatatgcatttcggaaggcacatcccagtactttaggagtcagaagtgggaggatctcttgaggccaggagttcaagaccagtctgggcaatatcacaagacttggtctctacaaaaagtaaaatttaaaaaaa

SEQ ID NO: 129435 - DNA, 477 bp, Homo sapiens
  Payload ID: 5315
  Gene Symbol: ELK4
  Gene Name: ELK4, ETS-domain protein (SRF accessory protein 1)
  ENST ID: ENST00000468523
  CDS Start-End: 46-477
gcagaactgaccagctgtgagatcagaaggcaccagctcattgctatggacagtgctatcaccctgtggcagttccttcttcagctcctgcagaagcctcagaacaagcacatgatctgttggacctctaatgatgggcagtttaagcttttgcaggcagaagaggtggctcgtctctgggggattcgcaagaacaagcctaacatgaattatgacaaactcagccgagccctcagatactattatgtaaagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactct

SEQ ID NO: 129436 - DNA, 4955 bp, Homo sapiens
  Payload ID: 5316
  Gene Symbol: ERC1
  Gene Name: ELKS/RAB6-interacting/CAST family member 1
  Uniprot ID: Q8IUD2
  ENST ID: ENST00000347735
  CDS Start-End: 407-3253
gtgctgtggcggcggcggcggcggtagtggcggcggcggcggtgcctgggcggcagcagcagcagtagcggcagccctgaggacggtgagacggccgcggcggcggcgacagcgcggaagtcgcgcgggacccagagcttcccccctgtcgctagtgctgaggctttcgcctttcctacccagcttcttgctcacggcccgggctgggctgggcagggcaacgcgcccccggggaggggcggagctgtagatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctaga

SEQ ID NO: 129437 - DNA, 5796 bp, Homo sapiens
  Payload ID: 5316
  Gene Symbol: ERC1
  Gene Name: ELKS/RAB6-interacting/CAST family member 1
  ENST ID: ENST00000355446
  CDS Start-End: 133-3393
gattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagaatccgttgcatcccaaagccatggaaaaactgccttttttcatgtgatgctcatgcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtgg

SEQ ID NO: 129438 - DNA, 5789 bp, Homo sapiens
  Payload ID: 5316
  Gene Symbol: ERC1
  Gene Name: ELKS/RAB6-interacting/CAST family member 1
  Uniprot ID: Q8IUD2
  ENST ID: ENST00000360905
  CDS Start-End: 182-3532
agcagtagcggcagccctgaggacgatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtgg

SEQ ID NO: 129439 - DNA, 9118 bp, Homo sapiens
  Payload ID: 5316
  Gene Symbol: ERC1
  Gene Name: ELKS/RAB6-interacting/CAST family member 1
  Uniprot ID: Q8IUD2
  ENST ID: ENST00000397203
  CDS Start-End: 158-3424
gatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtcactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcaggaggcaggagaatcgcttgagcctgggaggcagaggctgcggtgagccgagatcgtgtcactgcactccagcctgggtgacagagactccatttaaaaaaaaaaaaaaaaaatatatatatatatatatatatatatatatggatgggaatcaccaaattcatctcagctctaaccttttaacctttgtccttgcactttacaatctaaagatctacctgtggctctcagacttcctcacacttgggttttagaaataacttgtaaagcagactggacccaaggccgccttcagtgtcaagaagggcattgtgacttgcccctcaatttctgtccattgaagtctggttttccatgaggaacttgcgggctcacccacccccagagtgagagaagaggaaggcgaagtcatcacagacacggtcttagccacctgctgaactaatccctccgctattgagggtcagggttgtgaggcaaccatcatgtgtcaccccaaaatataaatgtttctgagccgcccatccactggcatttggatttgctgccagagtcctgttcctcccagaaccatcccgccctcctgttgaccatgttacttgagtgtaggcccggtgtcaagaccctcagagtctttgaggaaagagccaagcagagaagaccgctgcgtggagtgtgacaccacatggcatttctcaagcccagcggaccctgtgtcagcaaataccagtaatttaacatctgctcctggcctcctcttcacctgcctgggttcggaactgaggaggaaggatgagaagagactgcaatgcagcaggcaccctctgcagagtgaggccgcccgtccatcactgccagccctgggctgctcaggaggggacgtgaaccactcaaaggaatgtcttaaagaggatctggagtttcccccatgcaaattagggaagaattaggcaagaaaagacatacattacagggaaatccttctgaacaaaatggctgtcttcacctactcttcttgcaagaaaagacatacattacagggaaatccttctgaacaaaatggctatcttcacctactcttcagcaaaaaccgtctccagactttttagtgtcaaaaatgtaaccaactgtctcctgattttttccaatgtgtttggcaagtgctgtggccctgttgtaggtacttctcctgactcttgggggagaagtggttttagggattgatttgggggagcgggtttttgtcccatcccacctcctctcttctttctctgcttgtcgatattgtctgtgtgattcagagaattggggcagttacattgtgtctgttgttgagattattaaaagattaaaacgtagttgtagaaatgaaaaattaaacagctgtgttttaaaaatgcaaaccaatatcttgttaataaaggaattcaagctatggggcagccacactcccctcctcccaggctggcataggtggccctgggctggcggcttaggaagcatggagcacacttagggtagtgcctgcctgggcaagagacacctgccgagcaaaaggaacgagaatctggggctcagagcctcgcagttgtgccaggattttcctatacatgttcaggacctctgggtagaggtttcacagtttgtgaccccataaccaccctcacccgacgtgggttctagctcagtgtgcctaatactgcatggtaacctgggcttgaccctgaagcccctgcctggcaggccacaggacctctcctgcccacttggtgctatctcttccagtgaccacccagcacgggtgagcactggccagcctggagcctgcaatccaggtggaacagactgtcctccatgtcagttccttctggcttcaggccctcaattatttccctttgagcttttttagaccctagatctcctaggcccaggctctctcttgaccccagagaagccactgtcaggaaaggaagtgaaccctactgaagccagagaattcaccccggccaaagcaggccctctgggtccagcccctcattccacaccacgccagtattgcatccatctactgcagctacacatcctgagggcagcaccacccactctggcctgctggcccatcgcaggactagcccaggcacctgccgggcattgcaggatatccagtggggcctgtgactgctccctgatgcgtcagaagagaagtgttgcactttagtggaggagctgaggagcacctgcccccttgtagcttgagttccttttggtaacagtagcagcctccatggtggtgtctgggatgcacgtgcacccgctgccttcagctgtatgtgtgtgttcctgctggagttgtgttactgacaggataatgacattacaaagaaattgtgttatattcaactttgccttgataattattgtaaacactttgttcattttttcttttttattcacaaactaaatccaccaggaaattataaagttattt

SEQ ID NO: 129440 - DNA, 7040 bp, Homo sapiens
  Payload ID: 5316
  Gene Symbol: ERC1
  Gene Name: ELKS/RAB6-interacting/CAST family member 1
  Uniprot ID: Q8IUD2
  ENST ID: ENST00000440394
  CDS Start-End: 378-3356
gcggcggcggcggtgcctgggcggcagcagcagcagtagcggcagccctgaggacggtgagacggccgcggcggcggcgacagcgcggaagtcgcgcgggacccagagcttcccccctgtcgctagtgctgaggctttcgcctttcctacccagcttcttgctcacggcccgggctgggctgggcagggcaacgcgcccccggggaggggcggagctgtagatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtcactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcaggaggcaggagaatcgcttgagcctgggaggcagaggctgcggtgagccgagatcgtgtcactgcactccagcctgggtgacagagactccatttaaaaaaaaaaaaaaaaaa

SEQ ID NO: 129441 - DNA, 9241 bp, Homo sapiens
  Payload ID: 5316
  Gene Symbol: ERC1
  Gene Name: ELKS/RAB6-interacting/CAST family member 1
  Uniprot ID: Q8IUD2
  ENST ID: ENST00000543086
  CDS Start-End: 272-3538
gggcgcggtgacgtcgcgggcgcctgggccgtgctgtggcggcggcggcggcggtagtggcggcggcggcggtgcctgggcggcagcagcagcagtagcggcagccctgaggacgatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtcactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcaggaggcaggagaatcgcttgagcctgggaggcagaggctgcggtgagccgagatcgtgtcactgcactccagcctgggtgacagagactccatttaaaaaaaaaaaaaaaaaatatatatatatatatatatatatatatatggatgggaatcaccaaattcatctcagctctaaccttttaacctttgtccttgcactttacaatctaaagatctacctgtggctctcagacttcctcacacttgggttttagaaataacttgtaaagcagactggacccaaggccgccttcagtgtcaagaagggcattgtgacttgcccctcaatttctgtccattgaagtctggttttccatgaggaacttgcgggctcacccacccccagagtgagagaagaggaaggcgaagtcatcacagacacggtcttagccacctgctgaactaatccctccgctattgagggtcagggttgtgaggcaaccatcatgtgtcaccccaaaatataaatgtttctgagccgcccatccactggcatttggatttgctgccagagtcctgttcctcccagaaccatcccgccctcctgttgaccatgttacttgagtgtaggcccggtgtcaagaccctcagagtctttgaggaaagagccaagcagagaagaccgctgcgtggagtgtgacaccacatggcatttctcaagcccagcggaccctgtgtcagcaaataccagtaatttaacatctgctcctggcctcctcttcacctgcctgggttcggaactgaggaggaaggatgagaagagactgcaatgcagcaggcaccctctgcagagtgaggccgcccgtccatcactgccagccctgggctgctcaggaggggacgtgaaccactcaaaggaatgtcttaaagaggatctggagtttcccccatgcaaattagggaagaattaggcaagaaaagacatacattacagggaaatccttctgaacaaaatggctgtcttcacctactcttcttgcaagaaaagacatacattacagggaaatccttctgaacaaaatggctatcttcacctactcttcagcaaaaaccgtctccagactttttagtgtcaaaaatgtaaccaactgtctcctgattttttccaatgtgtttggcaagtgctgtggccctgttgtaggtacttctcctgactcttgggggagaagtggttttagggattgatttgggggagcgggtttttgtcccatcccacctcctctcttctttctctgcttgtcgatattgtctgtgtgattcagagaattggggcagttacattgtgtctgttgttgagattattaaaagattaaaacgtagttgtagaaatgaaaaattaaacagctgtgttttaaaaatgcaaaccaatatcttgttaataaaggaattcaagctatggggcagccacactcccctcctcccaggctggcataggtggccctgggctggcggcttaggaagcatggagcacacttagggtagtgcctgcctgggcaagagacacctgccgagcaaaaggaacgagaatctggggctcagagcctcgcagttgtgccaggattttcctatacatgttcaggacctctgggtagaggtttcacagtttgtgaccccataaccaccctcacccgacgtgggttctagctcagtgtgcctaatactgcatggtaacctgggcttgaccctgaagcccctgcctggcaggccacaggacctctcctgcccacttggtgctatctcttccagtgaccacccagcacgggtgagcactggccagcctggagcctgcaatccaggtggaacagactgtcctccatgtcagttccttctggcttcaggccctcaattatttccctttgagcttttttagaccctagatctcctaggcccaggctctctcttgaccccagagaagccactgtcaggaaaggaagtgaaccctactgaagccagagaattcaccccggccaaagcaggccctctgggtccagcccctcattccacaccacgccagtattgcatccatctactgcagctacacatcctgagggcagcaccacccactctggcctgctggcccatcgcaggactagcccaggcacctgccgggcattgcaggatatccagtggggcctgtgactgctccctgatgcgtcagaagagaagtgttgcactttagtggaggagctgaggagcacctgcccccttgtagcttgagttccttttggtaacagtagcagcctccatggtggtgtctgggatgcacgtgcacccgctgccttcagctgtatgtgtgtgttcctgctggagttgtgttactgacaggataatgacattacaaagaaattgtgttatattcaactttgccttgataattattgtaaacactttgttcattttttcttttttattcacaaactaaatccaccaggaaattataaagttatttaaaaaccgt

SEQ ID NO: 129442 - DNA, 4390 bp, Homo sapiens
  Payload ID: 5316
  Gene Symbol: ERC1
  Gene Name: ELKS/RAB6-interacting/CAST family member 1
  ENST ID: ENST00000546231
  CDS Start-End: 529-3891
gggccgtgctgtggcggcggcggcggcggtagtggcggcggcggcggtgcctgggcggcagcagcagcagtagcggcagccctgaggacggtgagacggccgcggcggcggcgacagcgcggaagtcgcgcgggacccagagcttcccccctgtcgctagtgctgaggctttcgcctttcctacccagcttcttgctcacggcccgggctgggctgggcagggcaacgcgcccccggggaggggcggagctgtaggttggtcttgaactcctggcctcaagcgatcttcctaccttggcctcccagagcgctgggattataggcatgagccattgcacttggcactttttttgtttgttttccagttgcatgatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaa

SEQ ID NO: 129443 - DNA, 2881 bp, Homo sapiens
  Payload ID: 5316
  Gene Symbol: ERC1
  Gene Name: ELKS/RAB6-interacting/CAST family member 1
  Uniprot ID: Q8IUD2
  ENST ID: ENST00000545948
  CDS Start-End: 207-2369
gcggcggtgcctgggcggcagcagcagcagtagcggcagccctgaggacgatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccg

SEQ ID NO: 129444 - DNA, 4323 bp, Homo sapiens
  Payload ID: 5316
  Gene Symbol: ERC1
  Gene Name: ELKS/RAB6-interacting/CAST family member 1
  ENST ID: ENST00000542302
  CDS Start-End: 529-3459
gggccgtgctgtggcggcggcggcggcggtagtggcggcggcggcggtgcctgggcggcagcagcagcagtagcggcagccctgaggacggtgagacggccgcggcggcggcgacagcgcggaagtcgcgcgggacccagagcttcccccctgtcgctagtgctgaggctttcgcctttcctacccagcttcttgctcacggcccgggctgggctgggcagggcaacgcgcccccggggaggggcggagctgtaggttggtcttgaactcctggcctcaagcgatcttcctaccttggcctcccagagcgctgggattataggcatgagccattgcacttggcactttttttgtttgttttccagttgcatgatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaa

SEQ ID NO: 129445 - DNA, 868 bp, Homo sapiens
  Payload ID: 5316
  Gene Symbol: ERC1
  Gene Name: ELKS/RAB6-interacting/CAST family member 1
  ENST ID: ENST00000589132
  CDS Start-End: 433-868
agatgtggggatcctggggcgggaggtgggggagtggggactggggctctgggcacttggggagcggagggggggaggcttaggactagtgaagccgcggacgaggtagtggggagacggagaaattggggagccatgaggttggggtgcggtcagggtggatctttgggttagggtagtttgaagtttgagtatcctcacgacatggcagctggattcctgagagagagtgatttgagagagtgacgaagacagaagccccagtgtcttttaagaatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcagg

SEQ ID NO: 129446 - DNA, 546 bp, Homo sapiens
  Payload ID: 5316
  Gene Symbol: ERC1
  Gene Name: ELKS/RAB6-interacting/CAST family member 1
  ENST ID: ENST00000545318
  CDS Start-End: 278-546
gtcggaacgtggacactaatttccgcccacgctccccgcgtcctggcgggatcaccacagacacgacgtccattgctggggtcctcggcgatgcccgtgtgcgcagccccgcgagtctcagatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgac

SEQ ID NO: 129447 - DNA, 550 bp, Homo sapiens
  Payload ID: 5316
  Gene Symbol: ERC1
  Gene Name: ELKS/RAB6-interacting/CAST family member 1
  ENST ID: ENST00000539802
  CDS Start-End: 1-269
accacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcaggtgagcctctcactcaaactttgaaaagagcctgtgaaaatccagttgctgtgtaggttgatgcagtgggggctaccttggggaatccagttgccgtgtagttgatgcagtgggggctaccttggggaatcccgttgctgtgtaggttcatgcagtgggagctaccttggggaattccatgtttagattcaagatttggggggtggggaggggtttccagatataatttttaaactgatttttaattgattttttactgttttatttttttaattcaccaattaaaaatgtatgtttctcatgta

SEQ ID NO: 129448 - DNA, 2071 bp, Homo sapiens
  Payload ID: 5316
  Gene Symbol: ERC1
  Gene Name: ELKS/RAB6-interacting/CAST family member 1
  ENST ID: ENST00000588412
  CDS Start-End: 1-857
agatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctac

SEQ ID NO: 129449 - DNA, 1275 bp, Homo sapiens
  Payload ID: 5316
  Gene Symbol: ERC1
  Gene Name: ELKS/RAB6-interacting/CAST family member 1
  ENST ID: ENST00000592048
  CDS Start-End: 244-1275
agtggcggcggcggcggtgcctgggcggcagcagcagcagtagcggcagccctgaggacggtgagacggccgcggcggcggcgacagcgcggaagtcgcgcgggacccagagcttcccccctgtcgctagtgctgaggctttcgcctttcctacccagcttcttgctcacggcccgggctgggctgggcagggcaacgcgcccccggggaggggcggagctgtaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgag

SEQ ID NO: 129450 - DNA, 9202 bp, Homo sapiens
  Payload ID: 5316
  Gene Symbol: ERC1
  Gene Name: ELKS/RAB6-interacting/CAST family member 1
  Uniprot ID: Q8IUD2
  ENST ID: ENST00000589028
  CDS Start-End: 158-3508
gatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtcactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcaggaggcaggagaatcgcttgagcctgggaggcagaggctgcggtgagccgagatcgtgtcactgcactccagcctgggtgacagagactccatttaaaaaaaaaaaaaaaaaatatatatatatatatatatatatatatatggatgggaatcaccaaattcatctcagctctaaccttttaacctttgtccttgcactttacaatctaaagatctacctgtggctctcagacttcctcacacttgggttttagaaataacttgtaaagcagactggacccaaggccgccttcagtgtcaagaagggcattgtgacttgcccctcaatttctgtccattgaagtctggttttccatgaggaacttgcgggctcacccacccccagagtgagagaagaggaaggcgaagtcatcacagacacggtcttagccacctgctgaactaatccctccgctattgagggtcagggttgtgaggcaaccatcatgtgtcaccccaaaatataaatgtttctgagccgcccatccactggcatttggatttgctgccagagtcctgttcctcccagaaccatcccgccctcctgttgaccatgttacttgagtgtaggcccggtgtcaagaccctcagagtctttgaggaaagagccaagcagagaagaccgctgcgtggagtgtgacaccacatggcatttctcaagcccagcggaccctgtgtcagcaaataccagtaatttaacatctgctcctggcctcctcttcacctgcctgggttcggaactgaggaggaaggatgagaagagactgcaatgcagcaggcaccctctgcagagtgaggccgcccgtccatcactgccagccctgggctgctcaggaggggacgtgaaccactcaaaggaatgtcttaaagaggatctggagtttcccccatgcaaattagggaagaattaggcaagaaaagacatacattacagggaaatccttctgaacaaaatggctgtcttcacctactcttcttgcaagaaaagacatacattacagggaaatccttctgaacaaaatggctatcttcacctactcttcagcaaaaaccgtctccagactttttagtgtcaaaaatgtaaccaactgtctcctgattttttccaatgtgtttggcaagtgctgtggccctgttgtaggtacttctcctgactcttgggggagaagtggttttagggattgatttgggggagcgggtttttgtcccatcccacctcctctcttctttctctgcttgtcgatattgtctgtgtgattcagagaattggggcagttacattgtgtctgttgttgagattattaaaagattaaaacgtagttgtagaaatgaaaaattaaacagctgtgttttaaaaatgcaaaccaatatcttgttaataaaggaattcaagctatggggcagccacactcccctcctcccaggctggcataggtggccctgggctggcggcttaggaagcatggagcacacttagggtagtgcctgcctgggcaagagacacctgccgagcaaaaggaacgagaatctggggctcagagcctcgcagttgtgccaggattttcctatacatgttcaggacctctgggtagaggtttcacagtttgtgaccccataaccaccctcacccgacgtgggttctagctcagtgtgcctaatactgcatggtaacctgggcttgaccctgaagcccctgcctggcaggccacaggacctctcctgcccacttggtgctatctcttccagtgaccacccagcacgggtgagcactggccagcctggagcctgcaatccaggtggaacagactgtcctccatgtcagttccttctggcttcaggccctcaattatttccctttgagcttttttagaccctagatctcctaggcccaggctctctcttgaccccagagaagccactgtcaggaaaggaagtgaaccctactgaagccagagaattcaccccggccaaagcaggccctctgggtccagcccctcattccacaccacgccagtattgcatccatctactgcagctacacatcctgagggcagcaccacccactctggcctgctggcccatcgcaggactagcccaggcacctgccgggcattgcaggatatccagtggggcctgtgactgctccctgatgcgtcagaagagaagtgttgcactttagtggaggagctgaggagcacctgcccccttgtagcttgagttccttttggtaacagtagcagcctccatggtggtgtctgggatgcacgtgcacccgctgccttcagctgtatgtgtgtgttcctgctggagttgtgttactgacaggataatgacattacaaagaaattgtgttatattcaactttgccttgataattattgtaaacactttgttcattttttcttttttattcacaaactaaatccaccaggaaattataaagttattt

SEQ ID NO: 129451 - DNA, 2832 bp, Homo sapiens
  Payload ID: 5316
  Gene Symbol: ERC1
  Gene Name: ELKS/RAB6-interacting/CAST family member 1
  Uniprot ID: Q8IUD2
  ENST ID: ENST00000611180
  CDS Start-End: 158-2320
gatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccg

SEQ ID NO: 129452 - DNA, 6138 bp, Homo sapiens
  Payload ID: 5317
  Gene Symbol: ERC2
  Gene Name: ELKS/RAB6-interacting/CAST family member 2
  Uniprot ID: O15083
  ENST ID: ENST00000288221
  CDS Start-End: 257-3130
gctcgctcggtctccggctccggcgccggctcctgctcctcctggccgcccggggccaaggcgacgagaggttgtaaaaatccatgtgggacggccccggggcgagcatcggaaagatctctgagtggagttattttctggtacggactgtgaaaagaatgcggtgaaaattctggacaatcgtggaaatattagctcaaaccccaacttaatatagcatttcttctcttcagtaacacctcataatacaagaaaaatgtatggaagtgcaagaacaatcaccaatctggaaggtagcccttccagatcccctcgtttgccaaggtctcctcgtttgggccaccgaagaacaagtagtgggggaggtggaggaacaggcaagactctgtctatggagaatatccagtccctcaatgcagcctatgctacgtctggacccatgtatctgagtgatcatgaaggggtggcttcaacaacctacccaaagggcactatgactctgggaagggctacaaatcgagctgtatatggaggccgtgtcacagccatggggagtagtcccaatattgcttctgctggactttcccacacagatgtcctttcatacacagatcaacatggtgggctgactggctcatcccatcatcaccaccaccaggtcccctccatgttgaggcaggtaagagacagcacaatgttagatcttcaggcccagctgaaagaactgcagagagagaatgacctcctccggaaagagctagacatcaaggacagcaaattgggatcttccatgaacagtattaagactttctggagtcctgagcttaagaaggagagagtcttgaggaaagaagaggcagcgcggatgtctgtcctcaaggagcagatgagggtttcccatgaagaaaatcagcacctacagttgacaatccaggcccttcaagatgagctgcgaacccagagagacctcaaccacctcctccagcaagagagtggcaaccgaggagcggagcacttcaccatcgagctgaccgaggagaactttaggcggctccaagccgagcatgacaggcaggctaaggagctgttccttttgaggaagacattagaggaaatggagctgagaattgaaacgcagaaacaaaccctcaatgcccgagatgagtcaattaaaaaacttcttgagatgttgcaaagtaaaggcttgccatccaaaagcctggaggatgacaatgagcgaacgcggcggatggcagaggctgagtctcaggtcagccacttggaagtgattttagatcagaaagagaaggaaaacatacatcttagagaggaattgcaccgaagaagccaacttcagccggagccagccaagacgaaggctctccagactgtcatcgaaatgaaggacacaaaaatcgcttcattggaacgaaacataagggatcttgaggatgagatccagatgttaaaagccaatggtgtgctgaacactgaggaccgcgaagaagagatcaaacaaattgaggtttacaaaagtcactccaagtttatgaagaccaagattgatcagctgaagcaggaactttcaaagaaagagtcggaacttcttgccttacaaacaaagcttgaaaccctcagcaatcaaaattcagattgcaagcaacacattgaagtgctcaaagagtcacttactgccaaagaacagagggctgccatccttcagactgaggtagatgcgctgagattacgactggaagaaaaagaatctttcctcaataaaaaaacaaaacagctacaggacctcacagaagagaaggggacactggccggtgaaattcgtgacatgaaagatatgttagaagtgaaggaaagaaaaatcaatgttcttcagaaaaagattgaaaacttgcaagaacaacttagggataaagacaagcaactgaccaacctgaaagacagagtgaagtccttgcagacggattccagtaatacagatactgcactggcgacgctagaggaagctctgtcagagaaggagagaataattgagcgcttgaaagaacagcgagaaagagatgatcgggaaagactagaagagatagaatccttccgaaaagagaacaaagacctgaaagagaaggtcaatgctttacaggctgaactgactgagaaagagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaaggcacataatattgaagatgactccaggatgaaccctgagtttgcagaccaaataaaacagctcgataaagaggcgtcttactaccgcgacgagtgtggcaaggcccaagcggaagtggaccggttgctggagatcctcaaggaggtggagaatgagaagaatgacaaggacaagaagatcgcagaactggagagcttgactctcaggcatatgaaagatcagaataagaaggtggccaacctcaagcacaatcaacagttggaaaagaagaaaaatgctcagttactagaagaagtgcgcaggcgagaagacagcatggctgacaactcacagcatttgcagatagaggaactgatgaatgcactggagaagaccagacaggaactggatgccaccaaagcacgcctcgcctccacacaacagtccctggccgaaaaagaagcgcacttggccaacctccggattgagaggaggaaacagctggaggagatcctggagatgaaacaggaagcactacttgcagccatcagtgaaaaagatgcaaacattgccttgctggaattgtctgcctccaaaaagaaaaagacgcaggaagaagtcatggccctcaagcgggaaaaagaccgactagtacatcaattaaagcagcagacccagaacagaatgaagttgatggcagacaactatgatgatgaccatcaccattaccaccaccaccaccatcaccaccaccatcgatctcctgggaggtcgcaacattccaatcacaggccctctccggaccaggatgacgaggagggcatatgggcatagccgggcctgtaaaccaaagttccagttttgttttgagggctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttggcagtgtttgtataccatgatgcatggagtgtttgacgaagaaacaaaaaacaccaaaaattgcgagcctttaccctcctctatttctttaatctgttgtttgaagaaccgcattttgagggtgtaaccagtagtcacctctgggccaggttggaaaagaaatcaattttttaaaccactaatgcttgccaagaaatcgccttatgagaacatggtgtgtgtctctgacaatgcgtggcacatctaaattgatcattcataattttatctacccagtcatgtactggagagtggcaaaagtctgaggcacctgcatatctctagtccctgtgttctgcacatccccacggtggggacgccaccaagcctcagactcttaccatcccggtgcatgcaggtctccatgaagaagctgggactcattcacatttcaagatccaaatgctgtgcaaacagtgtaagcttagattttctgtaaatgaagggtcatttctctttttttttttttttaaagaaaatgtgtctgcaacatggattccaaagcattttcagcatcaaacatgaaaacattgatgaatgaggaacaatcacaaaagctgtgtctctgtatatagctctacacaacatgtatgtggatacagtcattatttaaagcacatgccagggaaaaagaccaaattttgaggtcttttacatacagtgatatggtactaaggagaattaaactcctactgcttcctctgaatattaagaaacaatttaaattgttataacttcataaaactcatgactgagtctggcaaacatgtgcaactcttgtattgctccattttcttgtcaatggaagaaacccttccacgtgtatgcaagtgggagatgaaaacctgcatttttaaaggacaaacagtgaatttaagcatgagtggccttaataaatatagttgtctttctttgctgctgtggaaaggattctaaacagatgtccctgaagtcttgcattgaatttagtcattattattactttttaaaatgttggtgcaattaactctggacctctcttgtgagccatagagatatttaaaagacaaacaccttatttgtcggggaagatgaaaccgtccctgagttgcaccattctttcttggtgcattcgcggttaagatactcaagcaggtttcttgcttctggctttgttcttgtcatcagtaagtataacaaactatgtaatgcttatgtgttgcataaacaatccaaatgcattcatgttttaaaagtttgtcctttaactatcagagggatctaggtcttggttagagaagtaagcagagttctttgcaagcttatttagcacattttgacacaatgttgcactgaaaacccaggccacaaatgtgtcccagtgaacagtttggatgtcctcaaagaagtggttctcactgcctcctacaaccaggtcttgacctgaactctgcaactgaatacttgaagtaggaagtaggaaatccagtagggaaaatagggtccttgaaacagaaaaaaaaaaccaacccatgtatagctagctatttctatgtatgtgccaattttgtcacagctcttgtttggagggatcattttctgcccaactttcattggttaaaatattactgatcttacctttatgaggtcgtataatttagtcccttaaaaattaaattctctctaacataacaacctttcccatttcgtgtaatattctctgatgtttgggggttaccaaaaatatccctttttcacatattaagaatagtctctgggtttacaacaaacactgtgatgttgggaagctatttcctttgcgcaaactttaacaggttttcttctaatcataacatagttgaaaaaagaagtttgggctaacatttaggagaagttggtcttactttgtgcaaaagcaggcttgtgctttataccccatttgatttcgatgtacagtctcaattttgtatttaatgatttttgtgtatccagtatgcacgttaacagcgtgtcaactttcatttgaaagtgggtttcaatttactttttaaacagtgtttatgacgagacctcagatgtgttgacgtaagctctatctgcaatgtttttgtgtagagtggcgattgaatgctgcccagggtcagtgtatctaattccccgagaccctcgtttgatagtgcttcttgtaatatttcttcaagtgagtggcatgtgggttgtgatattgaccatgtgattatggacatcgatatgaaaaataaataaataaaactaaggaaccctggaaactaccagtgggcatgtattagccagtcattgtaacctcgtgtctagtagaacaatgtacaaggtatgtacagttcataaatttgttgtcatgtgtatgagaagtactttgtgctgatcgccttatttatattcatcaaataaaccttgtttctttctgaagtg

SEQ ID NO: 129453 - DNA, 1585 bp, Homo sapiens
  Payload ID: 5317
  Gene Symbol: ERC2
  Gene Name: ELKS/RAB6-interacting/CAST family member 2
  ENST ID: ENST00000492584
  CDS Start-End: 1-1585
gaagaagccaacttcagccggagccagccaagacgaaggctctccagactgtcatcgaaatgaaggacacaaaaatcgcttcattggaacgaaacataagggatcttgaggatgagatccagatgttaaaagccaatggtgtgctgaacactgaggaccgcgaagaagagatcaaacaaattgaggtttacaaaagtcactccaagtttatgaagaccaagattgatcagctgaagcaggaactttcaaagaaagagtcggaacttcttgccttacaaacaaagcttgaaaccctcagcaatcaaaattcagattgcaagcaacacattgaagtgctcaaagagtcacttactgccaaagaacagagggctgccatccttcagactgaggtagatgcgctgagattacgactggaagaaaaagaatctttcctcaataaaaaaacaaaacagctacaggacctcacagaagagaaggggacactggccggtgaaattcgtgacatgaaagatatgttagaagtgaaggaaagaaaaatcaatgttcttcagaaaaagattgaaaacttgcaagaacaacttagggataaagacaagcaactgaccaacctgaaagacagagtgaagtccttgcagacggattccagtaatacagatactgcactggcgacgctagaggaagctctgtcagagaaggagagaataattgagcgcttgaaagaacagcgagaaagagatgatcgggaaagactagaagagatagaatccttccgaaaagagaacaaagacctgaaagagaaggtcaatgctttacaggctgaactgactgagaaagagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaagcaagctgagcagttgttcaatcagatgtacaacccagcacataatattgaagatgactccaggatgaaccctgagtttgcagaccaaataaaacagctcgataaagaggcgtcttactaccgcgacgagtgtggcaaggcccaagcggaagtggaccggttgctggagatcctcaaggaggtggagaatgagaagaatgacaaggacaagaagatcgcagaactggagaggcatatgaaagatcagaataagaaggtggccaacctcaagcacaatcaacagttggaaaagaagaaaaatgctcagttactagaagaagtgcgcaggcgagaagacagcatggctgacaactcacagcatttgcagatagaggaactgatgaatgcactggagaagaccagacaggaactggatgccaccaaagcacgcctcgcctccacacaacagtccctggccgaaaaagaagcgcacttggccaacctccggattgagaggaggaaacagctggaggagatcctggagatgaaacaggaagcactacttgcagccatcagtgaaaaagatgcaaacattgccttgctggaattgtctgcctccaaaaagaaaaa

SEQ ID NO: 129454 - DNA, 3831 bp, Homo sapiens
  Payload ID: 5317
  Gene Symbol: ERC2
  Gene Name: ELKS/RAB6-interacting/CAST family member 2
  Uniprot ID: O15083
  ENST ID: ENST00000460849
  CDS Start-End: 231-3104
cggctcctgctcctcctggccgcccggggccaaggcgacgagaggttgtaaaaatccatgtgggacggccccggggcgagcatcggaaagatctctgagtggagttattttctggtacggactgtgaaaagaatgcggtgaaaattctggacaatcgtggaaatattagctcaaaccccaacttaatatagcatttcttctcttcagtaacacctcataatacaagaaaaatgtatggaagtgcaagaacaatcaccaatctggaaggtagcccttccagatcccctcgtttgccaaggtctcctcgtttgggccaccgaagaacaagtagtgggggaggtggaggaacaggcaagactctgtctatggagaatatccagtccctcaatgcagcctatgctacgtctggacccatgtatctgagtgatcatgaaggggtggcttcaacaacctacccaaagggcactatgactctgggaagggctacaaatcgagctgtatatggaggccgtgtcacagccatggggagtagtcccaatattgcttctgctggactttcccacacagatgtcctttcatacacagatcaacatggtgggctgactggctcatcccatcatcaccaccaccaggtcccctccatgttgaggcaggtaagagacagcacaatgttagatcttcaggcccagctgaaagaactgcagagagagaatgacctcctccggaaagagctagacatcaaggacagcaaattgggatcttccatgaacagtattaagactttctggagtcctgagcttaagaaggagagagtcttgaggaaagaagaggcagcgcggatgtctgtcctcaaggagcagatgagggtttcccatgaagaaaatcagcacctacagttgacaatccaggcccttcaagatgagctgcgaacccagagagacctcaaccacctcctccagcaagagagtggcaaccgaggagcggagcacttcaccatcgagctgaccgaggagaactttaggcggctccaagccgagcatgacaggcaggctaaggagctgttccttttgaggaagacattagaggaaatggagctgagaattgaaacgcagaaacaaaccctcaatgcccgagatgagtcaattaaaaaacttcttgagatgttgcaaagtaaaggcttgccatccaaaagcctggaggatgacaatgagcgaacgcggcggatggcagaggctgagtctcaggtcagccacttggaagtgattttagatcagaaagagaaggaaaacatacatcttagagaggaattgcaccgaagaagccaacttcagccggagccagccaagacgaaggctctccagactgtcatcgaaatgaaggacacaaaaatcgcttcattggaacgaaacataagggatcttgaggatgagatccagatgttaaaagccaatggtgtgctgaacactgaggaccgcgaagaagagatcaaacaaattgaggtttacaaaagtcactccaagtttatgaagaccaagattgatcagctgaagcaggaactttcaaagaaagagtcggaacttcttgccttacaaacaaagcttgaaaccctcagcaatcaaaattcagattgcaagcaacacattgaagtgctcaaagagtcacttactgccaaagaacagagggctgccatccttcagactgaggtagatgcgctgagattacgactggaagaaaaagaatctttcctcaataaaaaaacaaaacagctacaggacctcacagaagagaaggggacactggccggtgaaattcgtgacatgaaagatatgttagaagtgaaggaaagaaaaatcaatgttcttcagaaaaagattgaaaacttgcaagaacaacttagggataaagacaagcaactgaccaacctgaaagacagagtgaagtccttgcagacggattccagtaatacagatactgcactggcgacgctagaggaagctctgtcagagaaggagagaataattgagcgcttgaaagaacagcgagaaagagatgatcgggaaagactagaagagatagaatccttccgaaaagagaacaaagacctgaaagagaaggtcaatgctttacaggctgaactgactgagaaagagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaaggcacataatattgaagatgactccaggatgaaccctgagtttgcagaccaaataaaacagctcgataaagaggcgtcttactaccgcgacgagtgtggcaaggcccaagcggaagtggaccggttgctggagatcctcaaggaggtggagaatgagaagaatgacaaggacaagaagatcgcagaactggagagcttgactctcaggcatatgaaagatcagaataagaaggtggccaacctcaagcacaatcaacagttggaaaagaagaaaaatgctcagttactagaagaagtgcgcaggcgagaagacagcatggctgacaactcacagcatttgcagatagaggaactgatgaatgcactggagaagaccagacaggaactggatgccaccaaagcacgcctcgcctccacacaacagtccctggccgaaaaagaagcgcacttggccaacctccggattgagaggaggaaacagctggaggagatcctggagatgaaacaggaagcactacttgcagccatcagtgaaaaagatgcaaacattgccttgctggaattgtctgcctccaaaaagaaaaagacgcaggaagaagtcatggccctcaagcgggaaaaagaccgactagtacatcaattaaagcagcagacccagaacagaatgaagttgatggcagacaactatgatgatgaccatcaccattaccaccaccaccaccatcaccaccaccatcgatctcctgggaggtcgcaacattccaatcacaggccctctccggaccaggatgacgaggagggcatatgggcatagccgggcctgtaaaccaaagttccagttttgttttgagggatgatccagctctgtcggaggcacgtaggcacagccaaatctcatgctgtacattgatcacctgtccaacctttgcctagagtgggagcccccagttccttcgagatccaacattacctgtctgtaaagaagaagaggaggagggagacagcggggaggatccggtggcagtttaacaccagagcagctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttgg

SEQ ID NO: 129455 - DNA, 3831 bp, Homo sapiens; identical to SEQ ID NO: 129454
  Payload ID: 5317
  Gene Symbol: ERC2
  Gene Name: ELKS/RAB6-interacting/CAST family member 2
  Uniprot ID: O15083
  ENST ID: ENST00000612797
  CDS Start-End: 231-3104

SEQ ID NO: 129456 - DNA, 4690 bp, Homo sapiens
  Payload ID: 5318
  Gene Symbol: EAF1
  Gene Name: ELL associated factor 1
  Uniprot ID: Q96JC9
  ENST ID: ENST00000396842
  CDS Start-End: 426-1232
catcagttcctaaattcacctgcagggctagggccaggcgcactcaccccacagccagccccactgggcctcggaggcagaatacgggaagaaccgcgaaacaaccctaaaccaattctgaggaccacgaattcggattatccgggagttcttttgccatggcaccgcccccgccacttccgctaggaacccggaagttcctacccgacgccggaagtcccacggccttgcctcctcagattcctctctcacccccacgcagaggagagaacttgcttctggacccgggtgggtgccggctcggctctccttgtcttccagagcggtggcccggaagcacagtcctcccagacgccagcgccagaagctcggatcgcggctgcaccgggagagcgccgatctgggtgcgaggcaggtgcggggccatgaatgggaccgcaaacccgctgctggaccgcgaggaacattgcctgaggctcggggagagcttcgagaagcggccgcgggcctccttccacactattcgttatgattttaaaccagcatctatagacacttcctgtgaaggagagcttcaagttggcaaaggagatgaagtcacaattacactgccacatatccctggatccacaccacccatgactgtgttcaaggggaacaaacggccttaccagaaagactgtgtgcttattattaatcatgacactggtgaatatgtgctggaaaaactcagtagcagcattcaggtgaagaaaacaagagctgagggcagcagtaaaatccaggcccgaatggaacagcagcccactcgtcctccacagacgtcacagccaccaccacctccaccacctatgccattcagagctccaacgaagcctccagttggacccaaaacttctcccttgaaagataacccctcacctgaacctcagttggatgacatcaaaagagagctgagggctgaagttgacattattgaacaaatgagcagcagcagtgggagcagctcttcagactctgagagctcttcgggaagtgatgacgatagctccagcagtggaggcgaggacaatggcccagcctctcctccgcagccttcacaccagcagccctacaacagtaggcctgccgttgccaatggaaccagccggccacaaggaagcaaccagctcatgaacaccctcagaaatgacttgcagttgagtgagtctggcagtgacagtgatgactagtgctggatctttcgaaacctactttttggtgcacaaacatgccgcaagactgagctactttggcgtggagtccattgcaagaggaaaatgttatggatcagtgactgtagtaggagtttgaggctctggaactctcacatattcaagtctttaacttagtggtgatgggtgattttctcgtgtcatttttgaacaatctcatctttcaaagtttaagtagacctgtagaagagctaacagaattatatttctatttagttaaaattgttaatgaaaaacagataaatgtgccctggtctaagttactcaaaggccatatcttcaccaggccagagattcagttttaaacctcagcagccatcagtttggccaagtggttggtaccagtggaatgaagtctttgatgggtaggagagagagggaaaacctcaaactacatcatagaagtatgttaaaaccactttaaattgttgacacaaagtggtaaggaagttttgtctgactcagcctgacaagcctggatagaaatggacctcagaatacagaatggagtccttgagtgtcagttggtgaggaccatggagtcctgccagctcaacctgtcatttacagactaagaaagggaagtacacacctggcttgtggccagtctcctgccccctctctgggctttcctcactgttctctcccttgaatctcatttgtaggaatcaagagattcctatacatgggacttttagatgtacattggcacttggattagattccaaaagacaaaagtgttgggtgcttctagcttgaattcagtccctaaatacatgaggctgggtgagcagatgaaaccggtagccactgtgctgatgcatgtgactccattcagttggggattttggttccatgtggatccatactaagtattcttcagtcagtggattttagcaaggggaggtaggagtggaagagaggtgtgaagaaacctctccgaacaaatgaaccagcagtaagtttctaaaaatcagaatctagatagaagttctgcaatatgaaatgagcacattctttgataaggcgtatctattcatgcttttgtaccactgttttgtacctgactccctgaccgatttgtattttttatatacaactagaaggaagtcacaagattgccttctacagtgtgccatttccaaatggatctgttgttggaggaaactggttgctagtcaatgttctatatttaatgaatgtgtgataaatcatcctgtaatcagtatggagtaacctgtttttgtagtttggatgaatatgtcctgagaaatttccatccactttggttcagcggacatcaaggtagtaataataatttttcctccacaggtccctccactcatatggcctctccctccccagctagtggaggggaagcagtctggacttagaaaggaaataggtggtctgtcataggggctttcattagagttaaacttcatagagtcaactgtttcatcatcatagtgagcccagagagccactgcccagcagcatgctcacaccacctaccctagtgtaggtaataggtctacgctaggaccccgtgctgggctctcagcccatcatgagattttggtggatttaatggcaggtaggaacttatttatagtggattgataattgctttataattccttggtaatgacagctcagggaaggtttcacaaggtcatgatcaggagacttgaattgttactggatgtaggaattgtttcactgctcttaacttgctcaaactggggcaggttccaggaacttgaactaaaaatatctatttaagcctctctctctttctctcctccccaacttttttctgaaagccttgatttctgtagacagaactatggtttttggcatgttgggtcaagacgtgtttctataggaaatgcttgcacgtggcactggcttggtgagtcaagcttcctgagcttcagaccgtttgtcctgtcatctgtcctgcccaacactgtatggtttttctctagcacggcttcaattttgttctctgcacaaagcctttggtggttctgccctctgccctccagctttacccaccagagtaagcaatcttttctttttagaaatcaagaatttggcttcacagatggcttctcacagatgccctcctgccagccaaaccggacttgttcttcctgcctctgtgccttctctcattctccttctctccctccataccccacttttgaggttctgtgggtaccatctttgtggactcttgtcttttttttcaacccacatggagtgccctgtgtgtacatactgaccttttttttttttttttttttttgcttgaactctggtcggtatgagctccttaaaagcaggtactgggctggctgtggtgactcatgcctgtaatcccagcactttgggaggctgaggtgggaggattgcttgagtccaggagtttgagaccagcctgggcaacatggcgagaccctgtttctacaaaaagaaaaagggaaaaaaaaagcagggactgtcattctcatctcctccctggggtatccacaggaatggacattcaaatggttgtagcctggtggggtagaaggcagagaagactacccagccagtgaagtgcagaggatagacataggaaaacattccaggcatttggagacagctgaaagtatccatgctgactttcatgatttagaagtctttaactgaattattaaaattgccttttttttgtgctgtacaatgtctactgtactgtgggtcatttagatgagatgaaaaacttaattaaatctgaagtgtcagaggcgcttagtaagccttagtaaagttgtgattgaagaaacttaatacaaatgaactagaggtttgtaatcatgccactcactaacgattttatttctgtagcagaatcattttttctatgtaaggtgttaatgtgtgtgtatgtgctttggttgtaggaaaacttgaaaattccaaaatccttattttcctatttgagaggctggttcagcagggtgtgtgtgtgtgtgtgtgtgtgtgtgtatgaatggtatatttattacattattttgaaagagaattagtgtgttatgtggataatgttatatacagccaaagtggatgtttctatttggcaaggaaggtaggatttctgaaactcaggccttaaccaataggttggaagacaagaccaattgaagagttaggaaatgtgagtttttgttacttctgttattccagtcttggtttcattgtctcattctttatttttaaaatcttgtgcctaaaagtttttttgcttaattatgaagtagacatgcatgtttacatttatgtaaaatatttgctgtgtaaagtattttttgtttattctcttaaaagatcactatatttaaataaaagtgaaggtcagcaacaca

SEQ ID NO: 129457 - DNA, 1037 bp, Homo sapiens
  Payload ID: 5318
  Gene Symbol: EAF1
  Gene Name: ELL associated factor 1
  ENST ID: ENST00000449565
  CDS Start-End: 183-386
ctctctcacccccacgcagaggagagaacttgcttctggacccgggtgggtgccggctcggctctccttgtcttccagagcggtggcccggaagcacagtcctcccagacgccagcgccagaagctcggatcgcggctgcaccgggagagcgccgatctgggtgcgaggcaggtgcggggccatgaatgggaccgcaaacccgctgctggaccgcgaggaacattgcctgaggctcggggagagcttcgagaagcggccgcgggcctccttccacactattcgttatgattttaaaccagcatctatagacacttcctgtgaaggagagcttcaagttggcaaaggagatgaagtcacaattacactgccacatatccctagctgagggcagcagtaaaatccaggcccgaatggaacagcagcccactcgtcctccacagacgtcacagccaccaccacctccaccacctatgccattcagagctccaacgaagcctccagttggacccaaaacttctcccttgaaagataacccctcacctgaacctcagttggatgacatcaaaagagagctgagggctgaagttgacattattgaacaaatgagcagcagcagtgggagcagctcttcagactctgagagctcttcgggaagtgatgacgatagctccagcagtggaggcgaggacaatggcccagcctctcctccgcagccttcacaccagcagccctacaacagtaggcctgccgttgccaatggaaccagccggccacaaggaagcaaccagctcatgaacaccctcagaaatgacttgcagttgagtgagtctggcagtgacagtgatgactagtgctggatctttcgaaacctactttttggtgcacaaacatgccgcaagactgagctactttggcgtggagtccattgcaagaggaaaatgttatggatcagtgactgtagtaggagtttgaggctctggaactctcacatattcaagtctttaacttagtggtgatgggtgattttctcgtgtca

SEQ ID NO: 129458 - DNA, 992 bp, Homo sapiens
  Payload ID: 5319
  Gene Symbol: EAF2
  Gene Name: ELL associated factor 2
  Uniprot ID: Q96CJ1
  ENST ID: ENST00000273668
  CDS Start-End: 72-854
agctgcttcaggctgaggtggcagatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactgagggaaatatgtcttaacttttgatgataaaagaaattaaatttgattcagaaatttca

SEQ ID NO: 129459 - DNA, 960 bp, Homo sapiens
  Payload ID: 5319
  Gene Symbol: EAF2
  Gene Name: ELL associated factor 2
  ENST ID: ENST00000451944
  CDS Start-End: 50-841
agatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggaattgtgtctcaggacatcctaccatgacacagtacaggattcctgatatagatgccagtcataatagatttcgagacaacagtggccttctgatgaatactttaaataatctttcctctcactccttttcaagtttatatgatcctctgctcagtcattaaagttggagtttctcaaggcttacttttgggttctttttttcttttcattctacaatttctccctaaataacttcctccatgtttctgttgcagtcaatacttatgtgtaggtaacttgc

SEQ ID NO: 129460 - DNA, 829 bp, Homo sapiens
  Payload ID: 5319
  Gene Symbol: EAF2
  Gene Name: ELL associated factor 2
  ENST ID: ENST00000490434
  CDS Start-End: 104-310
gtctgggtgacttggctggcgggatcaagtgcagctgcttcaggctgaggtggcagatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctatgacttcaaacctgcttctattgacacttcttctgaaggataccttgaggttggtgaaggtgaacaggtgaccataactctgccaaatatagaaagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactga

SEQ ID NO: 129461 - DNA, 643 bp, Homo sapiens
  Payload ID: 5319
  Gene Symbol: EAF2
  Gene Name: ELL associated factor 2
  ENST ID: ENST00000490477
  CDS Start-End: 10-117
agagtaattatgaatagcgcagcgggattctcacacctagaccgtcgcgagcgggttctcaagttaggggagagtttcgagaagcagccgcgctgcgccttccacactgtgcgctagctccccacgatgagatggtgctgtgctggctctgcagtttctctctcttcagtcccattttccggaagtgtgatatgcgtctttatctggtttttccatgcctttttctcaaatagtatctactctctccttttctcttccttctcagatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagag

SEQ ID NO: 129462 - DNA, 6431 bp, Homo sapiens
  Payload ID: 5320
  Gene Symbol: EVC
  Gene Name: Ellis van Creveld protein
  Uniprot ID: P57679
  ENST ID: ENST00000264956
  CDS Start-End: 185-3163
ccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaactataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggtagagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactcccaccattcgtggcaaccaaggatgtctccagacactgccccgtgtccatggggttatcacccactgtgctgagtcaaagggtgccttgccctggtctaatccaggacatagccgtggatacgtccaaaaatccccagaacctagtgagccctctggctctgggagcccctatctcaggaattttcagggtcatttgtgacttttcatttcttaaaacctgaaatagactctcttagaaacaagtgactccttcccagtggccaaaacttaatcatcagagcgcttccttcagttcctcacccatcagccagtgggctctccaaagttaaccaacagctccctcttgtggttcactaaaaaacttggttattccatggagttgtgcaaagctatggcttccttggtgcaatattcttaaaacctgctttgcatagaaatcacttttgcccaggctggagtgcagtggcgtgatctcggctcatggcaatctccatctcccgggttcaagcgattttcctgcctcagcctccccagtagctgggactacagacgtgtgccaccacgcctggctaaatcttttttgtattttattttagtagagacggggtttcaccatactggccaggctgctctcgaactcctgacctcatcgtccacctgcctcggcctccccaaagtgctgagattaggcgttagccaccgcgcccggccagaaatcacttttatattgtcacatgggccctctgcacagagtccgatggctcctcccggggaagcctgattttgtgacgtgtgtatagtaaatgcaggccctctggcagcaccataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcaggtaccctgcctccattttggttaccatccccacttattatgggctgtgggctgttatggtgatggatggatgtggatttggaaggggaccatgagagatgatgtattatgatgaactcatgatttaattctttggtgaaaata

SEQ ID NO: 129463 - DNA, 1960 bp, Homo sapiens
  Payload ID: 5320
  Gene Symbol: EVC
  Gene Name: Ellis van Creveld protein
  ENST ID: ENST00000509451
  CDS Start-End: 167-1774
cagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaactataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccagaaggccatgagaagacatagagacacagggaaggaggctgtttgaagacagaaggagggactggagtgatgcagccacaagccgaggaacacctgcagccaccaaaagccagaagagcccaggaagggcccctcccagagcctttggagggggcgaggctctgccaacaccttggtttcatactaatgccctccggaacggtgagagaataaacttcgttgtcttaatgca

SEQ ID NO: 129464 - DNA, 4828 bp, Homo sapiens
  Payload ID: 5321
  Gene Symbol: EVC2
  Gene Name: Ellis van Creveld syndrome 2
  Uniprot ID: Q86UK5
  ENST ID: ENST00000310917
  CDS Start-End: 733-4419
ttataaattctcagcttctcgaaccccatggccttgtccatgttaggtcaggaaaggcctgtccttggatggtctgggttatggggagagaggctgccaggggccaggctcgctggcctgagactttatagacagcctaacagcctgccccgcaggaaggctggcgggagtggagccctcccccgtcaacaggtgtcagctgtcacccaggacctaggcagggatgaggaagcacacaaaaggctccaccagtccccctttttgtgtctttctcctcctcctcctcctgcgtcccttggcaaagcaaatccctgtcccctcggagagttcagggagagcttgcttagggctgcgacttcagacaccagctcccctctttctaggtccccagagaggtggcccagcggctggcctgtttcccactgggaatgcgaggggcacccgggccggcccagggctgacccacagcaggctcgggcagtgggtgctcagctggtctgcactgaacgcaaccggaagtgagggtccttttccttctctgcggccaccccctcctccccgagctttcctgaaccttctgggtgctccaggactcccggccccgcgctccaaatgcttctccgttttctaagcggggatggggaaactctggattcacatccgtgtgtcaggaaaccgttcccaggggaagtgcgtctgagctgaggcttacagacccaggacttgccctgtatgatttggcccaaagtggaatgctgtcactttaagactgcagtggaagcaccacttggaatgaaattggacaagaaaatggaagtcttcatcccactctcaacttctgcagcctctagtgggccatgggctcattccttatttgcttttataccctcctggcctaagaagaacttatttaaaagagagtctcctataacacaccgcctgtatggggacatttcaagagaagttcaagggacttctgaaaatggagtaatttttcagaaatgtgcactggtgtctgggtcgagtgaagcacagacagcccgcatatggctgcttgttaacaacaccaagacaacctcgtcagccaacctctcggagctgctcttgctggacagcattgctggtctcaccatttgggactctgtgggaaacaggacctcggaaggattccaggcttttagcaagaagtttctgcaagtgggagatgcctttgctgtcagctacgcagccacgctccaggctggagacctcgggaacggggagagcctcaagcttcctgcccaactcacctttcagagctcgtcacggaacagaacacagctgaaagtgcttttttccataacagcagaagaaaacgtaacggttctgccgcaccacggcctccacgcagcagggttcttcattgccttcctcctctcccttgtgctgacctgggctgccctcttcctcatggttcgctatcagtgtctgaagggaaacatgctcaccagacatcgggtttggcagtatgagagcaagctggaacccttgccgttcacctcagctgatggcgtgaatgaggacctttcccttaacgaccaaatgatagacattctgtcttccgaggaccctgggagcatgcttcaagccttagaagagttggagattgcaaccctgaatcgggcagatgcagatctggaggcttgtcgaacacaaatcagcaaggatatcattgcccttctgctgaaaaatctcaccagcagtggccacctctcaccccaagtagagagaaaaatgagtgctgttttcaaaaagcagtttctattgctggaaaatgaaatacaagaggagtacgatcggaagatggtggcattgacagctgaatgtgacctggaaacaagaaagaagatggaaaaccagtaccagagagagatgatggcaatggaggaagcagaagagttgctgaaacgtgctggtgagaggtctgctgtagagtgcagcaaccttctgcggaccctccatggcctggaacaggagcacttgaggaagtctctcgctttgcaacaagaagaagactttgccaaagctcacagacagctggctgttttccagagaaatgaactgcacagtatcttttttacccagataaaaagtgctattttcaaaggggaattgaaaccagaggcagctaaaatgctgctgcaaaattattctaaaatacaggagaatgtagaagagttaatggactttttccaggctagtaagaggtatcatctaagtaaaagatttggccacagggaatatctggtccagaacctccagtcatcagagacccgtgtgcagggccttctgagcaccgctgcagcccagctgactcacctcattcagaagcacgagagagcagggtacctggatgaagaccaaatggaaatgctattggagcgggctcagacagaagtcttttcaatcaagcagaagttggacaatgacttaaagcaggaaaagaaaaagctccaccaaaaattaataactaagagaagacgagagttgctacaaaagcacagggagcagcgtagggagcaggcgtccgtcggcgaggccttccgaacggttgaggatgccggccagtacctgcaccagaagaggagcctgatggaggagcacggtgccaccctggaggagctgcaggagcgtctggaccaggccgccctggacgatctcaggaccctgaccctttcgctgtttgaaaaggccaccgacgagctgcggcgcctgcagaactcagccatgacccaggagctgctcaagcgtggggtgccctggctcttcctgcagcagatcctggaggagcacggcaaggagatggctgcacgggccgagcagctggagggggaggagagggacagggaccaggagggtgtccagagcgtgaggcagagactgaaggatgacgctcctgaggccgtgacagaggagcaggcagagctgcgacgctgggagcacctgatcttcatgaagctctgctcctcagtcttctccctgtctgaagaggagctgctcaggatgaggcaggaggtccatggctgctttgctcagatggacaggagcttggccctccccaagatccgggcccgagttctgctgcagcaatttcagactgcgtggcgagaagcagagttcgtgaagctggaccaggccgtggctgcccctgagctgcagcaacagtccaaggtgagaaagtcacggtccaagagtaaaagcaagggagagcttctgaagaagtgcatcgaagacaaaattcacctctgtgaggaacaggcctctgaagacctggtggaaaaggttcgaggtgaattgctgcgggagagagtgcagcggatggaggcacaggagggaggctttgcacagtcgcttgttgctctgcagttccagaaggcgtcccgggtgaccgagactctgtcggcctacaccgccctcctcagcatccaggacttgctcctggaagagctgagtgcatctgagatgctgaccaagtcggcctgcacacagatcctggagtcgcacagccgggagctccaggagttggagaggaagctggaggaccagctggtgcagcaggaggcagcccagcagcagcaggccctggcgagctggcagcagtgggtggccgatgggcccgggattctgaacgaacctggggaggtggattctgaaaggcaggtctctactgtcctgcaccaagccctgagcaagagccagacattactggagcaacatcagcagtgtttgagagaggaacaacagaacagtgtcgtgctagaagacttgttggaaaacatggaggcagacacctttgcaaccctgtgcagccaggagctgagactggcatcgtacctggcgaggatggccatggtgcccggggccacgcttcgccggctcctgagtgtggtactgcccacagcctcacagcctcagctgctggccctgctggattcggccaccgagagacatgtggaccacgcagctgagagcgatggcggagcggagcaggccgacgtgggcaggcggaggaaacaccagagctggtggcaagccttagatggcaaactgcgaggagatctgataagcagaggattagaaaagatgctgtgggcccgcaagagaaagcagagcatattaaagaagacatgtctccctctcagagagaggatgatattctctggaaaaggaagttggccacacctgtcactggagcccattggcgaactggcccctgtacccattgtaggggcagaaaccattgatctattaaacacaggagagaagctctttatattcagaaatccaaaggagccagagatctcactgcacgttcctcccaggaaaaagaagaactttttgaatgccaaaaaggccatgagggccttgggcatggactagcccaagggaaagacctgcgggagcatctgaagagagaagggatgattttctcctgcccgccggtgtttgtgtgtttataatgcacaactcgcaaatataaattgcacatgcagaaggcacagaccccgtagcgcatgccaacttgcagggactcggtttaatcttgtctcatgaatttccagatggcccactctcttccatatcacaaggacataaacactccttctttcagccccacctccccagggccctggaggagacccccaccctgcaatccacaccccatcctctgctgcagaagctatggtctgtgtggtgacagccagattctctactcttatgttttgtatttgttacatattctatttttataaagggaattttaaaaaataaatgtgttttgcacaaa

SEQ ID NO: 129465 - DNA, 4390 bp, Homo sapiens
  Payload ID: 5321
  Gene Symbol: EVC2
  Gene Name: Ellis van Creveld syndrome 2
  Uniprot ID: Q86UK5
  ENST ID: ENST00000344408
  CDS Start-End: 55-3981
gctccagcgactcggcggcacccgccgctttgaggtagcgggtcccgacaggcgatggacccctcgggctcccgggggcgccccacgtgggtgctggccgggggtctcctggcagtggccctggcgctggggggccgaggctgtctcggcgccagctcacgtccccgctggcgccccctcggcgcgcagccaccccgggatccccaggtggctcctaggtctgggcccggcctgaggatccctccggggcggagcggggcggggcccgagagcagcacgcaggacttgccctgtatgatttggcccaaagtggaatgctgtcactttaagactgcagtggaagcaccacttggaatgaaattggacaagaaaatggaagtcttcatcccactctcaacttctgcagcctctagtgggccatgggctcattccttatttgcttttataccctcctggcctaagaagaacttatttaaaagagagtctcctataacacaccgcctgtatggggacatttcaagagaagttcaagggacttctgaaaatggagtaatttttcagaaatgtgcactggtgtctgggtcgagtgaagcacagacagcccgcatatggctgcttgttaacaacaccaagacaacctcgtcagccaacctctcggagctgctcttgctggacagcattgctggtctcaccatttgggactctgtgggaaacaggacctcggaaggattccaggcttttagcaagaagtttctgcaagtgggagatgcctttgctgtcagctacgcagccacgctccaggctggagacctcgggaacggggagagcctcaagcttcctgcccaactcacctttcagagctcgtcacggaacagaacacagctgaaagtgcttttttccataacagcagaagaaaacgtaacggttctgccgcaccacggcctccacgcagcagggttcttcattgccttcctcctctcccttgtgctgacctgggctgccctcttcctcatggttcgctatcagtgtctgaagggaaacatgctcaccagacatcgggtttggcagtatgagagcaagctggaacccttgccgttcacctcagctgatggcgtgaatgaggacctttcccttaacgaccaaatgatagacattctgtcttccgaggaccctgggagcatgcttcaagccttagaagagttggagattgcaaccctgaatcgggcagatgcagatctggaggcttgtcgaacacaaatcagcaaggatatcattgcccttctgctgaaaaatctcaccagcagtggccacctctcaccccaagtagagagaaaaatgagtgctgttttcaaaaagcagtttctattgctggaaaatgaaatacaagaggagtacgatcggaagatggtggcattgacagctgaatgtgacctggaaacaagaaagaagatggaaaaccagtaccagagagagatgatggcaatggaggaagcagaagagttgctgaaacgtgctggtgagaggtctgctgtagagtgcagcaaccttctgcggaccctccatggcctggaacaggagcacttgaggaagtctctcgctttgcaacaagaagaagactttgccaaagctcacagacagctggctgttttccagagaaatgaactgcacagtatcttttttacccagataaaaagtgctattttcaaaggggaattgaaaccagaggcagctaaaatgctgctgcaaaattattctaaaatacaggagaatgtagaagagttaatggactttttccaggctagtaagaggtatcatctaagtaaaagatttggccacagggaatatctggtccagaacctccagtcatcagagacccgtgtgcagggccttctgagcaccgctgcagcccagctgactcacctcattcagaagcacgagagagcagggtacctggatgaagaccaaatggaaatgctattggagcgggctcagacagaagtcttttcaatcaagcagaagttggacaatgacttaaagcaggaaaagaaaaagctccaccaaaaattaataactaagagaagacgagagttgctacaaaagcacagggagcagcgtagggagcaggcgtccgtcggcgaggccttccgaacggttgaggatgccggccagtacctgcaccagaagaggagcctgatggaggagcacggtgccaccctggaggagctgcaggagcgtctggaccaggccgccctggacgatctcaggaccctgaccctttcgctgtttgaaaaggccaccgacgagctgcggcgcctgcagaactcagccatgacccaggagctgctcaagcgtggggtgccctggctcttcctgcagcagatcctggaggagcacggcaaggagatggctgcacgggccgagcagctggagggggaggagagggacagggaccaggagggtgtccagagcgtgaggcagagactgaaggatgacgctcctgaggccgtgacagaggagcaggcagagctgcgacgctgggagcacctgatcttcatgaagctctgctcctcagtcttctccctgtctgaagaggagctgctcaggatgaggcaggaggtccatggctgctttgctcagatggacaggagcttggccctccccaagatccgggcccgagttctgctgcagcaatttcagactgcgtggcgagaagcagagttcgtgaagctggaccaggccgtggctgcccctgagctgcagcaacagtccaaggtgagaaagtcacggtccaagagtaaaagcaagggagagcttctgaagaagtgcatcgaagacaaaattcacctctgtgaggaacaggcctctgaagacctggtggaaaaggttcgaggtgaattgctgcgggagagagtgcagcggatggaggcacaggagggaggctttgcacagtcgcttgttgctctgcagttccagaaggcgtcccgggtgaccgagactctgtcggcctacaccgccctcctcagcatccaggacttgctcctggaagagctgagtgcatctgagatgctgaccaagtcggcctgcacacagatcctggagtcgcacagccgggagctccaggagttggagaggaagctggaggaccagctggtgcagcaggaggcagcccagcagcagcaggccctggcgagctggcagcagtgggtggccgatgggcccgggattctgaacgaacctggggaggtggattctgaaaggcaggtctctactgtcctgcaccaagccctgagcaagagccagacattactggagcaacatcagcagtgtttgagagaggaacaacagaacagtgtcgtgctagaagacttgttggaaaacatggaggcagacacctttgcaaccctgtgcagccaggagctgagactggcatcgtacctggcgaggatggccatggtgcccggggccacgcttcgccggctcctgagtgtggtactgcccacagcctcacagcctcagctgctggccctgctggattcggccaccgagagacatgtggaccacgcagctgagagcgatggcggagcggagcaggccgacgtgggcaggcggaggaaacaccagagctggtggcaagccttagatggcaaactgcgaggagatctgataagcagaggattagaaaagatgctgtgggcccgcaagagaaagcagagcatattaaagaagacatgtctccctctcagagagaggatgatattctctggaaaaggaagttggccacacctgtcactggagcccattggcgaactggcccctgtacccattgtaggggcagaaaccattgatctattaaacacaggagagaagctctttatattcagaaatccaaaggagccagagatctcactgcacgttcctcccaggaaaaagaagaactttttgaatgccaaaaaggccatgagggccttgggcatggactagcccaagggaaagacctgcgggagcatctgaagagagaagggatgattttctcctgcccgccggtgtttgtgtgtttataatgcacaactcgcaaatataaattgcacatgcagaaggcacagaccccgtagcgcatgccaacttgcagggactcggtttaatcttgtctcatgaatttccagatggcccactctcttccatatcacaaggacataaacactccttctttcagccccacctccccagggccctggaggagacccccaccctgcaatccacaccccatcctctgctgcagaagctatggtctgtgtggtgacagccagattctctactcttatgttttgtatttgttacatattctatttttataaagggaattttaaaaaataaatgtgttttgcacaaa

SEQ ID NO: 129466 - DNA, 4079 bp, Homo sapiens
  Payload ID: 5321
  Gene Symbol: EVC2
  Gene Name: Ellis van Creveld syndrome 2
  ENST ID: ENST00000509670
  CDS Start-End: 342-1700
tgctcagctggtctgcactgaacgcaaccggaagtgagggtccttttccttctctgcggccaccccctcctccccgagctttcctgaaccttctgggtgctccaggactcccggccccgcgctccaaatgcttctccgttttctaagcggggatggggaaactctggattcacatccgtgtgtcaggaaaccgttcccaggggaagtgcgtctgagctgaggcttacagacccaggtgtatcccgctcacggccagaaagcttcgagggaaactggagaccttcctcggggtgtggcagctgccggcttggacttcaccagcgaccctggacttgccctgtatgatttggcccaaagtggaatgctgtcactttaagactgcagtggaagcaccacttggaatgaaattggacaagaaaatggaagtcttcatcccactctcaacttctgcagcctctagtgggccatgggctcattccttatttgcttttataccctcctggcctaagaagaacttatttaaaagagagtctcctataacacaccgcctgtatggggacatttcaagagaagttcaagggacttctgaaaatggagtaatttttcagaaatgtgcactggtgtctgggtcgagtgaagcacagacagcccgcatatggctgcttgttaacaacaccaagacaacctcgtcagccaacctctcggagctgctcttgctggacagcattgctggtctcaccatttgggactctgtgggaaacaggacctcggaaggattccaggcttttagcaagaagtttctgcaagtgggagatgcctttgctgtcagctacgcagccacgctccaggctggagacctcgggaacggggagagcctcaagcttcctgcccaactcacctttcagagctcgtcacggaacagaacacagctgaaagtgcttttttccataacagcagaagaaaacgtaacggttctgccgcaccacggcctccacgcagcagggttcttcattgccttcctcctctcccttgtgctgacctgggctgccctcttcctcatggttcgctatcagtgtctgaagggaaacatgctcaccagacatcgggtttggcagtatgagagcaagctggaacccttgccgttcacctcagctgatggcgtgaatgaggacctttcccttaacgaccaaatgatagacattctgtcttccgaggaccctgggagcatgcttcaagccttagaagagttggagattgcaaccctgaatcgggcagatgcagatctggaggcttgtcgaacacaaatcagcaaggatatcattgcccttctgctgaaaaatctcaccagcagtggccacctctcaccccaagtagagagaaaaatgagtgctgttttcaaaaagcagtttctattgctggaaaatgaaatacaagaggagtacgatcggaagatggtggcattgacagctgaatgtgacctggaaacaagaaagaagatggaaaaccagtaccagagagagatgatggcaatggaggaagcagaagagttgctgaaacgtgctgtctgctgtagagtgcagcaaccttctgcggaccctccatggcctggaacaggagcacttgaggaagtctctcgctttgcaacaagaagaagactttgccaaagctcacagacagctggctgttttccagagaaatgaactgcacagtatcttttttacccagataaaaagtgctattttcaaaggggaattgaaaccagaggcagctaaaatgctgctgcaaaattattctaaaatacaggagaatgtagaagagttaatggactttttccaggctagtaagaggtatcatctaagtaaaagatttggccacagggaatatctggtccagaacctccagtcatcagagacccgtgtgcagggccttctgagcaccgctgcagcccagctgactcacctcattcagaagcacgagagagcagggtacctggatgaagaccaaatggaaatgctattggagcgggctcagacagaagtcttttcaatcaagcagaagttggacaatgacttaaagcaggaaaagaaaaagctccaccaaaaattaataactaagagaagacgagagttgctacaaaagcacagggagcagcgtagggagcaggcgtccgtcggcgaggccttccgaacggttgaggatgccggccagtacctgcaccagaagaggagcctgatggaggagcacggtgccaccctggaggagctgcaggagcgtctggaccaggccgccctggacgatctcaggaccctgaccctttcgctgtttgaaaaggccaccgacgagctgcggcgcctgcagaactcagccatgacccaggagctgctcaagcgtggggtgccctggctcttcctgcagcagatcctggaggagcacggcaaggagatggctgcacgggccgagcagctggagggggaggagagggacagggaccaggagggtgtccagagcgtgaggcagagactgaaggatgacgctcctgaggccgtgacagaggagcaggcagagctgcgacgctgggagcacctgatcttcatgaagctctgctcctcagtcttctccctgtctgaagaggagctgctcaggatgaggcaggaggtccatggctgctttgctcagatggacaggagcttggccctccccaagatccgggcccgagttctgctgcagcaatttcagactgcgtggcgagaagcagagttcgtgaagctggaccaggccgtggctgcccctgagctgcagcaacagtccaaggtgagaaagtcacggtccaagagtaaaagcaagggagagcttctgaagaagtgcatcgaagacaaaattcacctctgtgaggaacaggcctctgaagacctggtggaaaaggttcgaggtgaattgctgcgggagagagtgcagcggatggaggcacaggagggaggctttgcacagtcgcttgttgctctgcagttccagaaggcgtcccgggtgaccgagactctgtcggcctacaccgccctcctcagcatccaggacttgctcctggaagagctgagtgcatctgagatgctgaccaagtcggcctgcacacagatcctggagtcgcacagccgggagctccaggagttggagaggaagctggaggaccagctggtgcagcaggaggcagcccagcagcagcaggccctggcgagctggcagcagtgggtggccgatgggcccgggattctgaacgaacctggggaggtggattctgaaaggcaggtctctactgtcctgcaccaagccctgagcaagagccagacattactggagcaacatcagcagtgtttgagagaggaacaacagaacagtgtcgtgctagaagacttgttggaaaacatggaggcagacacctttgcaaccctgtgcagccaggagctgagactggcatcgtacctggcgaggatggccatggtgcccggggccacgcttcgccggctcctgagtgtggtactgcccacagcctcacagcctcagctgctggccctgctggattcggccaccgagagacatgtggaccacgcagctgagagcgatggcggagcggagcaggccgacgtgggcaggcggaggaaacaccagagctggtggcaagccttagatggcaaactgcgaggagatctgataagcagaggattagaaaagatgctgtgggcccgcaagagaaagcagagcatattaaagaagacatgtctccctctcagagagaggatgatattctctggaaaaggaagttggccacacctgtcactggagcccattggcgaactggcccctgtacccattgtaggggcagaaaccattgatctattaaacacaggagagaagctctttatattcagaaatccaaaggagccagagatctcactgcacgttcctcccaggaaaaagaagaactttttgaatgccaaaaaggccatgagggccttgggcatggactagcccaagggaaagacctgcgggagcatctgaagagagaagggatgattttctcctgcccg

SEQ ID NO: 129467 - DNA, 4456 bp, Homo sapiens
  Payload ID: 5321
  Gene Symbol: EVC2
  Gene Name: Ellis van Creveld syndrome 2
  ENST ID: ENST00000475313
  CDS Start-End: 733-4233
ttataaattctcagcttctcgaaccccatggccttgtccatgttaggtcaggaaaggcctgtccttggatggtctgggttatggggagagaggctgccaggggccaggctcgctggcctgagactttatagacagcctaacagcctgccccgcaggaaggctggcgggagtggagccctcccccgtcaacaggtgtcagctgtcacccaggacctaggcagggatgaggaagcacacaaaaggctccaccagtccccctttttgtgtctttctcctcctcctcctcctgcgtcccttggcaaagcaaatccctgtcccctcggagagttcagggagagcttgcttagggctgcgacttcagacaccagctcccctctttctaggtccccagagaggtggcccagcggctggcctgtttcccactgggaatgcgaggggcacccgggccggcccagggctgacccacagcaggctcgggcagtgggtgctcagctggtctgcactgaacgcaaccggaagtgagggtccttttccttctctgcggccaccccctcctccccgagctttcctgaaccttctgggtgctccaggactcccggccccgcgctccaaatgcttctccgttttctaagcggggatggggaaactctggattcacatccgtgtgtcaggaaaccgttcccaggggaagtgcgtctgagctgaggcttacagacccaggacttgccctgtatgatttggcccaaagtggaatgctgtcactttaagactgcagtggaagcaccacttggaatgaaattggacaagaaaatggaagtcttcatcccactctcaacttctgcagcctctagtgggccatgggctcattccttatttgcttttataccctcctggcctaagaagaacttatttaaaagagagtctcctataacacaccgcctgtatggggacatttcaagagaagttcaagggacttctgaaaatggagtaatttttcagaaatgtgcactggtgtctgggtcgagtgaagcacagacagcccgcatatggctgcttgttaacaacaccaagacaacctcgtcagccaacctctcggagctgctcttgctggacagcattgctggtctcaccatttgggactctgtgggaaacaggacctcggaaggattccaggcttttagcaagaagtttctgcaagtgggagatgcctttgctgtcagctacgcagccacgctccaggctggagacctcgggaacggggagagcctcaagcttcctgcccaactcacctttcagagctcgtcacggaacagaacacagctgaaagtgcttttttccataacagcagaagaaaacgtaacggttctgccgcaccacggcctccacgcagcagggttcttcattgccttcctcctctcccttgtgctgacctgggctgccctcttcctcatggttcgctatcagtgtctgaagggaaacatgctcaccagacatcgggtttggcagtatgagagcaagctggaacccttgccgttcacctcagctgatggcgtgaatgaggacctttcccttaacgaccaaatgatagacattctgtcttccgaggaccctgggagcatgcttcaagccttagaagagttggagattgcaaccctgaatcgggcagatgcagatctggaggcttgtcgaacacaaatcagcaaggatatcattgcccttctgctgaaaaatctcaccagcagtggccacctctcaccccaagtagagagaaaaatgagtgctgttttcaaaaagcagtttctattgctggaaaatgaaatacaagaggagtacgatcggaagatggtggcattgacagctgaatgtgacctggaaacaagaaagaagatggaaaaccagtaccagagagagatgatggcaatggaggaagcagaagagttgctgaaacgtgctggtgagaggtctgctgtagagtgcagcaaccttctgcggaccctccatggcctggaacaggagcacttgaggaagtctctcgctttgcaacaagaagaagactttgccaaagctcacagacagctggctgttttccagagaaatgaactgcacagtatcttttttacccagataaaaagtgctattttcaaaggggaattgaaaccagaggcagctaaaatgctgctgcaaaattattctaaaatacaggagaatgtagaagagttaatggactttttccaggctagtaagaggtatcatctaagtaaaagatttggccacagggaatatctggtccagaacctccagtcatcagagacccgtgtgcagggccttctgagcaccgctgcagcccagctgactcacctcattcagaagcacgagagagcagggtacctggatgaagaccaaatggaaatgctattggagcgggctcagacagaagtcttttcaatcaagcagaagttggacaatgacttaaagcaggaaaagaaaaagctccaccaaaaattaataactaagagaagacgagagttgctacaaaagcacagggagcagcgtagggagcaggcgtccgtcggcgaggccttccgaacggttgaggatgccggccagtacctgcaccagaagaggagcctgatggaggagcacggtgccaccctggaggagctgcaggagcgtctggaccaggccgccctggacgatctcaggaccctgaccctttcgctgtttgaaaaggccaccgacgagctgcggcgcctgcagaactcagccatgacccaggagctgctcaagcgtggggtgccctggctcttcctgcagcagatcctggaggagcacggcaaggagatggctgcacgggccgagcagctggagggggaggagagggacagggaccaggagggtgtccagagcgtgaggcagagactgaaggatgacgctcctgaggccgtgacagaggagcaggcagagctgcgacgctgggagcacctgatcttcatgaagctctgctcctcagtcttctccctgtctgaagaggagctgctcaggatgaggcaggaggtccatggctgctttgctcagatggacaggagcttggccctccccaagatccgggcccgagttctgctgcagcaatttcagactgcgtggcgagaagcagagttcgtgaagctggaccaggccgtggctgcccctgagctgcagcaacagtccaaggtgagaaagtcacggtccaagagtaaaagcaagggagagcttctgaagaagtgcatcgaagacaaaattcacctctgtgaggaacaggcctctgaagacctggtggaaaaggttcgaggtgaattgctgcgggagagagtgcagcggatggaggcacaggagggaggctttgcacagtcgcttgttgctctgcagttccagaaggcgtcccgggtgaccgagactctgtcggcctacaccgccctcctcagcatccaggacttgctcctggaagagctgagtgcatctgagatgctgaccaagtcggcctgcacacagatcctggagtcgcacagccgggagctccaggagttggagaggaagctggaggaccagctggtgcagcaggaggcagcccagcagcagcaggccctggcgagctggcagcagtgggtggccgatgggcccgggattctgaacgaacctggggaggtggattctgaaaggcaggtctctactgtcctgcaccaagccctgagcaagagccagacattactggagcaacatcagcagtgtttgagagaggaacaacagaacagtgtcgtgctagaagacttgttggaaaacatggaggcagacacctttgcaaccctgtgcagccaggagctgagactggcatcgtacctggcgaggatggccatggtgcccggggccacgcttcgccggctcctgagtgtggtactgcccacagcctcacagcctcagctgctggccctgctggattcggccaccgagagacatgtggaccacgcagctgagagcgatggcggagcggagcaggccgacgtgggcaggcggaggaaacaccagagctggtggcaagccttagatggcaaactgcgaggagatctgataagcagaggattagaaaagatgctgtgggcccgcaagagaaagcagaggtcagggaaccaagagagcttctggcagtacctggtagggactccagagattgggttaattgagtggatgtctgaaaaatgagaacttacctgcaagtttgtcccaaacatagatgagttacctcggactgagcagtgcaatcgttggagcctctgtttgcgtaatatggccctggaacaccaaggaagggcctgggagagctgctgttgttcctatgagcccagctgtgggcacactgcgctgacacaatgtcatggccctcatgacgaggatgacttggaggagccaatcctgacaactgacc

SEQ ID NO: 129468 - DNA, 8091 bp, Homo sapiens
  Payload ID: 5322
  Gene Symbol: ELMSAN1
  Gene Name: ELM2 and Myb/SANT-like domain containing 1
  Uniprot ID: Q6PJG2
  ENST ID: ENST00000286523
  CDS Start-End: 784-3921
gatgaagtggtagagctggttcctgctcgccgcggtgccgcgcgcgccggccggccgctgggcgctccgcgctcccagcctcgagttgtgcaatcctttgtagcacgccagagtcctcctcctccgctgttgcctctcgccctctctctttttttttttttcaagctgtgagctcaaccgatgagtcagagccgtgcaatcctgacactgcatcgcaggactgggggtgacacggagggaggcagagcgctcgcgaggcggacggcacgggtgcggggcgcgccgaggctcctgcatcgcaagcggggggtgacagcccgcgcgtcccgcccgggccctgccagcaaacttctcagcctcgggaggcgcgggctggcggaagccccgcgagcgccgcggggaggcgacggcgcctgtttgtttttaaaatcgggagtgcgtgcaggcggctggagtcccggaggcgaccgaaggcggcgacccgcggcggaagggggacagccgagcccggagcccggagcccgggcaagagctgggtgccagaaccctgtggagcatcatgaactgggaagagtagctgagccccagagcctctctggaagagaaaggaagagccagcagttctttctcccagtgtccgacctcactgtccagcgtcttcctctgcccctgctctgccctccctggctcctggactagagcccggcttccagcaggacgtttccccaggggatgggcgactgttgaaggggatctcaccgccagggctcagttggccacatcatgaacctccaggcccagcccaaggctcagaacaagcggaagcgttgcctcttcgggggccaggaaccagctcccaaggagcagccccctcccctgcagcccccccagcagtccatcagagtgaaggaggagcagtacctcgggcacgagggtccaggaggggcagtctccacctctcagcctgtggaactgccccctcctagcagcctggccctgctgaactctgtggtatatgggcctgagcggacctcagcagccatgctgtcccagcaggtggcctcagtaaagtggcccaactctgtgatggctccagggcggggcccggagcgtggaggaggtgggggtgtcagtgacagcagctggcagcagcagccaggccagcctccaccccattcaacatggaactgccacagtctgtccctctacagtgcaaccaaggggagcccgcatcctggagtgggagtcccgacttactataaccaccctgaggcactgaagcgggagaaagcggggggcccacagctggaccgctatgtgcgaccaatgatgccacagaaggtgcagctggaggtagggcggccccaggcacccctgaattctttccacgcagccaagaaacccccaaaccagtcactgcccctgcaacccttccagctggcattcggccaccaggtgaaccggcaggtcttccggcagggcccaccgcccccaaacccggtggctgccttccctccacagaagcagcagcagcagcagcaaccacagcagcagcagcagcagcagcaggcagccctaccccagatgccgctctttgagaacttctattccatgccgcagcaaccctcgcagcaaccccaggactttggcctgcagccagctgggccactgggacagtcccacctggctcaccacagcatggcaccctaccccttcccccccaacccagatatgaacccagaactgcgcaaggcccttctgcaggactcagccccgcagccagcgctacctcaggtccagatccccttcccccgccgctcccgccgcctctctaaggagggtatcctgcctcccagcgccctggatggggctggcacccagcctgggcaggaggccactggcaacctgttcctacatcactggcccctgcagcagccgccacctggctccctggggcagccccatcctgaagctctgggattcccgctggagctgagggagtcgcagctactgcctgatggggagagactagcacccaatggccgggagcgagaggctcctgccatgggcagcgaggagggcatgagggcagtgagcacaggggactgtgggcaggtgctacggggcggagtgatccagagcacgcgacggaggcgccgggcatcccaggaggccaatttgctgaccctggcccagaaggctgtggagctggcctcactgcagaatgcaaaggatggcagtggttctgaagagaagcggaaaagtgtattggcctcaactaccaagtgtggggtggagttttctgagccttccttagccaccaagcgagcacgagaagacagtgggatggtacccctcatcatcccagtgtctgtgcctgtgcgaactgtggacccaactgaggcagcccaggctggaggtcttgatgaggacgggaagggtcctgaacagaaccctgctgagcacaagccatcagtcatcgtcacccgcaggcggtccacccgaatccccgggacagatgctcaagctcaggcagaggacatgaatgtcaagttggagggggagccttccgtgcggaaaccaaagcagcggcccaggcccgagcccctcatcatccccaccaaggcgggcactttcatcgcccctcccgtctactccaacatcaccccataccagagccacctgcgctctcccgtgcgcctagctgaccacccctctgagcggagctttgagctacctccctacacgccgccccccatcctcagccctgtgcgggaaggctctggcctctacttcaatgccatcatatcaaccagcaccatccctgcccctcctcccatcacgcctaagagtgcccatcgcacgctgctccggactaacagtgctgaagtaaccccgcctgtcctctctgtgatgggggaggccaccccagtgagcatcgagccacggatcaacgtgggctcccggttccaggcagaaatccccttgatgagggaccgtgccctggcagctgcagatccccacaaggctgacttggtgtggcagccatgggaggacctagagagcagccgggagaagcagaggcaagtggaagacctgctgacagccgcctgctccagcattttccctggtgctggcaccaaccaggagctggccctgcactgtctgcacgaatccagaggagacatcctggaaacgctgaataagctgctgctgaagaagcccctgcggccccacaaccatccgctggcaacttatcactacacaggctctgaccagtggaagatggccgagaggaagctgttcaacaaaggcattgccatctacaagaaggatttcttcctggtgcagaagctgatccagaccaagaccgtggcccagtgcgtggagttctactacacctacaagaagcaggtgaaaatcggccgcaatgggactctaacctttggggatgtggatacgagcgatgagaagtcggcccaggaagaggttgaagtggatattaagacttcccaaaagttcccaagggtgcctcttcccagaagagagtccccaagtgaagagaggctggagcccaagagggaggtgaaggagcccaggaaggagggggaggaggaggtgccagagatccaagagaaggaggagcaggaagaggggcgagagcgcagcaggcgggcagcggcagtcaaagccacgcagacactacaggccaatgagtcggccagtgacatcctcatcctccggagccacgagtccaacgcccctgggtctgccggtggccaggcctcggagaagccaagggaagggacagggaagtcacgaagggcactacctttttcagagaagaagaaaaaaacagagacattcagtaagacccagaatcaggagaacactttcccctgtaaaaaatgtggcaggtaaggtgggcagcgctgtccccgctgggacccccgcgggctggtgcgcggagggggcgggggtggggtggaggggagggggaagaggtacaggcggtgtccgcctcgtttctggttggctcagcgggtttctagggctgtgacgtcatggggcagctttcggaaaatgacgcgagctggccggccgcggctgtgcagcgtgggggtgaaggtgaaggctggggctcctcgcgcacccgcgctgggggcccccgggtgggctaggccggttctgagcaacccccacccggctgcagggtgttttacaaggtgaagagccgcagtgcgcatatgaagagccacgcagagcaggagaagaaggctgcagcgctgaggctgaaggagaaagaggccgctgctgccgccgccgccgcccaccagcaggccctgcgggaggagagcggtgcgggcgacaagggctgagcgcgggagccaggctggcccagtcctgggcctcggcccttcccgcaccgccgccagcgcccgcagacaccctggcatctcaagagggagtgaggagaggattgcagggacttttccctgcgaaacaaatgagacaatgacataaacggctcttttatttatgaaggccctgggagcagcgttaagggctccaggatccagctctctttgcatttggtctgtcggaagctgtcctcgtgctttcctggaccgggagagtcccggtcccctcgggagggactccaccgcctctcacactccgatttctgctgctctgctgccccgcagtcttttccctttatttgcttccccctcctcccctcggcctccaggaagccaccgtggccggccaagcacaagctcacccactttggagcagcatttctcctccccagaggacctcgaaggctgcaacggccctgccccaagccccagaaaaagaaactcttggagggagtctgcgggcttctctgagaaggggcgcagcctgacacctgtgctgtccctgcagtctctaggcctgtctgagctgctcccgtgaccgtgtcctgagtggccacctcctccttgggagggaggccgcggcaggtactctccctttgctgcttgctggcggccttgctagggctagaaagttttctcagcgttgggggaggggctagcgttcttgtccaaagcactcatcctgctgcagggaagggagctgtacggaggctggaagctgcagggttaggcccgagagagcttttgacaagcctggctcttcctgcttcccacctttttggctgaatacctttgggtcctggaggctgccaagggcgcttcgccttgagcaggtcccggagaggctcagcctgcccctcctggggccagcctccttgcctctgctctgacctcagcagctacacctaaccccaccgcaccctacccagtgtcgatatccacaacccagcccccaggcctgcactttggagatttctggatccttccctgggagggagaggtctcctaactcgattggacaggagccttcattccttgactcgtgtcatttgggagctatttatttattcttagtatttaatttttaacatcctctcagggaccaggggcctcctgcttttcagaggcccgagtgcatttatcccaaaacgaggcatcttgacatcccctatccccaccccctaaattcccaaggccctaaggtccctcacctggttgctctggaagctcttgctgataggaatgatagcaacactgaaagagcgtgggaaggtggagggtgtcaccagacccacacagagcaagggagattaaggcagttcttgctgccccttctctggctgtgctttgcctgagggaagagttggcaagaggccagaattctagtttggtttatggggcctggattctggcttgaagaagccatatttggcatgggtgaagtgaaagggccaggaggttctggaggccccttcacttccagtcccatagcggggctcagctatttttctgatcttattcaactttagttgtgcaaaagaaattctaagtgaatgcgcgtatgacaggtcaacgtattaggaaggagccagaaagtattcatactgctactccttatgagatagccaagaagcatcatgtcagtaactgggagtggagagggagttttgttttgaaactatgcaggtatttttcagcatccatttgtacattagtatggttctacaggaccccagctgtggaagtaacaaatttcttctccctccagactcttggatgactacctagatccccagcttaccggttagtttcctccacaggcttccatgagctcagtgtcccaagacagcaaaaatctggtataccctgtagaagcaggggggtagcaaatttaggctctcttcgaaattacttgtacaatacgagtgccttcgcagcttagccccaaagtgctacttatgtttcccaaggtcttttctattcaaatcatatttggtttcaggcccctttatgggcatacggtaacagaaacctccatcattcatatgagacccttttgtcagtggtaacatcttgtacttggaaaaaaaatttttttttttttttttttttttttttgagacagagtctcattctgtcgcccaggctggagtgcagtggtgtgatcttggctcactgcaacctccgcctcttgggttaaaagaattctcctgcctcagcctcctgagtagctgggattataggcacacaccaccacacccagctaatctttttgtatttttttttttagtagagacagggtttcgccatgtcggccaggctggtcttgaactcctgacctcaggtggtccacccgcctcggcctcccaaagtgctggcattacaggcgtgaaccaccgtgcctggccggaagtctttaaaaaataaagtgattctactcttctaagcttacagagaccagaccaggtgaatgtaactggggaaaatcaagatggtacctctctgcattatcccgccagacactgtattttatgcattcatgtctaggatacagtgtgaaaattaaaaagtttagagggcagatgcaattgtggcaagtgacctgccaataaagcaggtgcagctatagaagctggcataggtatatccttaatggtgctttctccctgggcttgtctttttgttgtttttttccccctatattcagagctccttgagaagtgataaacacctccagctttctaacatcctccccacaccatctcaccatatccatctcccagcatccatctgcattcagctaagggcgggaaactgacctagtgcctgtgttgcagaccatttctgaggtctccaccatccaaggaggcacagccgtcattactgtcctccatgccttcagcagcccccctcacagctaaggtacataccaccccttctgccgcgcctccacccctggcaccaaggtcttctgctgcttatgtctaaagggatcacctatatttaactgcctcagtgacctaacctctttcttctcatgtgccagatgttaagatgaaggaggaatacaacacatactcaagcctcagcctgtttagttgttttcactggggctcgcttttctgggacggtatttattatcagactggcaagcctaactccataggtttacaggaagtagggatatttttataaaacaattgtgtcctccccacattttgctatgttaatatttgcttctaacaatttgcagctgtttcactttttcctcatttgtctctaagttgaaggctttgttggaggggacagagcacaggaacagccttgacagtctgtaattattgtacagatattttaatagcatataaataagtatattccttttattttgaaacaaaaatgatcagacactgccttttgtgtgtttgctgcctgtggcatccttttttaaaaagactgttacatattaaaatagtgtacatatataaatattacctcttttgctgtacagttgtgatagagactgaagattttattttttgtgtgctttttataagaaaaaaattaatacactaaagaatcttgctgatgtgattgtaatgtacctatgtaacttatttacttttgaatgttcttctgtatctttaaaccttttattaaataaggtttt

SEQ ID NO: 129469 - DNA, 7721 bp, Homo sapiens
  Payload ID: 5322
  Gene Symbol: ELMSAN1
  Gene Name: ELM2 and Myb/SANT-like domain containing 1
  Uniprot ID: Q6PJG2
  ENST ID: ENST00000394071
  CDS Start-End: 405-3542
gctgggtcacagcccgggccgcacagcccgggccgcaccgcccgctccgcgaggaagtgacgactgcgccgtcccgagagcaacaaagttagagtctgcgggccgcactcgcctgcgccccgcacccctccgagcagcccggggatccagcacgcaggtgccagaaccctgtggagcatcatgaactgggaagagtagctgagccccagagcctctctggaagagaaaggaagagccagcagttctttctcccagtgtccgacctcactgtccagcgtcttcctctgcccctgctctgccctccctggctcctggactagagcccggcttccagcaggacgtttccccaggggatgggcgactgttgaaggggatctcaccgccagggctcagttggccacatcatgaacctccaggcccagcccaaggctcagaacaagcggaagcgttgcctcttcgggggccaggaaccagctcccaaggagcagccccctcccctgcagcccccccagcagtccatcagagtgaaggaggagcagtacctcgggcacgagggtccaggaggggcagtctccacctctcagcctgtggaactgccccctcctagcagcctggccctgctgaactctgtggtatatgggcctgagcggacctcagcagccatgctgtcccagcaggtggcctcagtaaagtggcccaactctgtgatggctccagggcggggcccggagcgtggaggaggtgggggtgtcagtgacagcagctggcagcagcagccaggccagcctccaccccattcaacatggaactgccacagtctgtccctctacagtgcaaccaaggggagcccgcatcctggagtgggagtcccgacttactataaccaccctgaggcactgaagcgggagaaagcggggggcccacagctggaccgctatgtgcgaccaatgatgccacagaaggtgcagctggaggtagggcggccccaggcacccctgaattctttccacgcagccaagaaacccccaaaccagtcactgcccctgcaacccttccagctggcattcggccaccaggtgaaccggcaggtcttccggcagggcccaccgcccccaaacccggtggctgccttccctccacagaagcagcagcagcagcagcaaccacagcagcagcagcagcagcagcaggcagccctaccccagatgccgctctttgagaacttctattccatgccgcagcaaccctcgcagcaaccccaggactttggcctgcagccagctgggccactgggacagtcccacctggctcaccacagcatggcaccctaccccttcccccccaacccagatatgaacccagaactgcgcaaggcccttctgcaggactcagccccgcagccagcgctacctcaggtccagatccccttcccccgccgctcccgccgcctctctaaggagggtatcctgcctcccagcgccctggatggggctggcacccagcctgggcaggaggccactggcaacctgttcctacatcactggcccctgcagcagccgccacctggctccctggggcagccccatcctgaagctctgggattcccgctggagctgagggagtcgcagctactgcctgatggggagagactagcacccaatggccgggagcgagaggctcctgccatgggcagcgaggagggcatgagggcagtgagcacaggggactgtgggcaggtgctacggggcggagtgatccagagcacgcgacggaggcgccgggcatcccaggaggccaatttgctgaccctggcccagaaggctgtggagctggcctcactgcagaatgcaaaggatggcagtggttctgaagagaagcggaaaagtgtattggcctcaactaccaagtgtggggtggagttttctgagccttccttagccaccaagcgagcacgagaagacagtgggatggtacccctcatcatcccagtgtctgtgcctgtgcgaactgtggacccaactgaggcagcccaggctggaggtcttgatgaggacgggaagggtcctgaacagaaccctgctgagcacaagccatcagtcatcgtcacccgcaggcggtccacccgaatccccgggacagatgctcaagctcaggcagaggacatgaatgtcaagttggagggggagccttccgtgcggaaaccaaagcagcggcccaggcccgagcccctcatcatccccaccaaggcgggcactttcatcgcccctcccgtctactccaacatcaccccataccagagccacctgcgctctcccgtgcgcctagctgaccacccctctgagcggagctttgagctacctccctacacgccgccccccatcctcagccctgtgcgggaaggctctggcctctacttcaatgccatcatatcaaccagcaccatccctgcccctcctcccatcacgcctaagagtgcccatcgcacgctgctccggactaacagtgctgaagtaaccccgcctgtcctctctgtgatgggggaggccaccccagtgagcatcgagccacggatcaacgtgggctcccggttccaggcagaaatccccttgatgagggaccgtgccctggcagctgcagatccccacaaggctgacttggtgtggcagccatgggaggacctagagagcagccgggagaagcagaggcaagtggaagacctgctgacagccgcctgctccagcattttccctggtgctggcaccaaccaggagctggccctgcactgtctgcacgaatccagaggagacatcctggaaacgctgaataagctgctgctgaagaagcccctgcggccccacaaccatccgctggcaacttatcactacacaggctctgaccagtggaagatggccgagaggaagctgttcaacaaaggcattgccatctacaagaaggatttcttcctggtgcagaagctgatccagaccaagaccgtggcccagtgcgtggagttctactacacctacaagaagcaggtgaaaatcggccgcaatgggactctaacctttggggatgtggatacgagcgatgagaagtcggcccaggaagaggttgaagtggatattaagacttcccaaaagttcccaagggtgcctcttcccagaagagagtccccaagtgaagagaggctggagcccaagagggaggtgaaggagcccaggaaggagggggaggaggaggtgccagagatccaagagaaggaggagcaggaagaggggcgagagcgcagcaggcgggcagcggcagtcaaagccacgcagacactacaggccaatgagtcggccagtgacatcctcatcctccggagccacgagtccaacgcccctgggtctgccggtggccaggcctcggagaagccaagggaagggacagggaagtcacgaagggcactacctttttcagagaagaagaaaaaaacagagacattcagtaagacccagaatcaggagaacactttcccctgtaaaaaatgtggcaggtaaggtgggcagcgctgtccccgctgggacccccgcgggctggtgcgcggagggggcgggggtggggtggaggggagggggaagaggtacaggcggtgtccgcctcgtttctggttggctcagcgggtttctagggctgtgacgtcatggggcagctttcggaaaatgacgcgagctggccggccgcggctgtgcagcgtgggggtgaaggtgaaggctggggctcctcgcgcacccgcgctgggggcccccgggtgggctaggccggttctgagcaacccccacccggctgcagggtgttttacaaggtgaagagccgcagtgcgcatatgaagagccacgcagagcaggagaagaaggctgcagcgctgaggctgaaggagaaagaggccgctgctgccgccgccgccgcccaccagcaggccctgcgggaggagagcggtgcgggcgacaagggctgagcgcgggagccaggctggcccagtcctgggcctcggcccttcccgcaccgccgccagcgcccgcagacaccctggcatctcaagagggagtgaggagaggattgcagggacttttccctgcgaaacaaatgagacaatgacataaacggctcttttatttatgaaggccctgggagcagcgttaagggctccaggatccagctctctttgcatttggtctgtcggaagctgtcctcgtgctttcctggaccgggagagtcccggtcccctcgggagggactccaccgcctctcacactccgatttctgctgctctgctgccccgcagtcttttccctttatttgcttccccctcctcccctcggcctccaggaagccaccgtggccggccaagcacaagctcacccactttggagcagcatttctcctccccagaggacctcgaaggctgcaacggccctgccccaagccccagaaaaagaaactcttggagggagtctgcgggcttctctgagaaggggcgcagcctgacacctgtgctgtccctgcagtctctaggcctgtctgagctgctcccgtgaccgtgtcctgagtggccacctcctccttgggagggaggccgcggcaggtactctccctttgctgcttgctggcggccttgctagggctagaaagttttctcagcgttgggggaggggctagcgttcttgtccaaagcactcatcctgctgcagggaagggagctgtacggaggctggaagctgcagggttaggcccgagagagcttttgacaagcctggctcttcctgcttcccacctttttggctgaatacctttgggtcctggaggctgccaagggcgcttcgccttgagcaggtcccggagaggctcagcctgcccctcctggggccagcctccttgcctctgctctgacctcagcagctacacctaaccccaccgcaccctacccagtgtcgatatccacaacccagcccccaggcctgcactttggagatttctggatccttccctgggagggagaggtctcctaactcgattggacaggagccttcattccttgactcgtgtcatttgggagctatttatttattcttagtatttaatttttaacatcctctcagggaccaggggcctcctgcttttcagaggcccgagtgcatttatcccaaaacgaggcatcttgacatcccctatccccaccccctaaattcccaaggccctaaggtccctcacctggttgctctggaagctcttgctgataggaatgatagcaacactgaaagagcgtgggaaggtggagggtgtcaccagacccacacagagcaagggagattaaggcagttcttgctgccccttctctggctgtgctttgcctgagggaagagttggcaagaggccagaattctagtttggtttatggggcctggattctggcttgaagaagccatatttggcatgggtgaagtgaaagggccaggaggttctggaggccccttcacttccagtcccatagcggggctcagctatttttctgatcttattcaactttagttgtgcaaaagaaattctaagtgaatgcgcgtatgacaggtcaacgtattaggaaggagccagaaagtattcatactgctactccttatgagatagccaagaagcatcatgtcagtaactgggagtggagagggagttttgttttgaaactatgcaggtatttttcagcatccatttgtacattagtatggttctacaggaccccagctgtggaagtaacaaatttcttctccctccagactcttggatgactacctagatccccagcttaccggttagtttcctccacaggcttccatgagctcagtgtcccaagacagcaaaaatctggtataccctgtagaagcaggggggtagcaaatttaggctctcttcgaaattacttgtacaatacgagtgccttcgcagcttagccccaaagtgctacttatgtttcccaaggtcttttctattcaaatcatatttggtttcaggcccctttatgggcatacggtaacagaaacctccatcattcatatgagacccttttgtcagtggtaacatcttgtacttggaaaaaaaatttttttttttttttttttttttttttgagacagagtctcattctgtcgcccaggctggagtgcagtggtgtgatcttggctcactgcaacctccgcctcttgggttaaaagaattctcctgcctcagcctcctgagtagctgggattataggcacacaccaccacacccagctaatctttttgtatttttttttttagtagagacagggtttcgccatgtcggccaggctggtcttgaactcctgacctcaggtggtccacccgcctcggcctcccaaagtgctggcattacaggcgtgaaccaccgtgcctggccggaagtctttaaaaaataaagtgattctactcttctaagcttacagagaccagaccaggtgaatgtaactggggaaaatcaagatggtacctctctgcattatcccgccagacactgtattttatgcattcatgtctaggatacagtgtgaaaattaaaaagtttagagggcagatgcaattgtggcaagtgacctgccaataaagcaggtgcagctatagaagctggcataggtatatccttaatggtgctttctccctgggcttgtctttttgttgtttttttccccctatattcagagctccttgagaagtgataaacacctccagctttctaacatcctccccacaccatctcaccatatccatctcccagcatccatctgcattcagctaagggcgggaaactgacctagtgcctgtgttgcagaccatttctgaggtctccaccatccaaggaggcacagccgtcattactgtcctccatgccttcagcagcccccctcacagctaaggtacataccaccccttctgccgcgcctccacccctggcaccaaggtcttctgctgcttatgtctaaagggatcacctatatttaactgcctcagtgacctaacctctttcttctcatgtgccagatgttaagatgaaggaggaatacaacacatactcaagcctcagcctgtttagttgttttcactggggctcgcttttctgggacggtatttattatcagactggcaagcctaactccataggtttacaggaagtagggatatttttataaaacaattgtgtcctccccacattttgctatgttaatatttgcttctaacaatttgcagctgtttcactttttcctcatttgtctctaagttgaaggctttgttggaggggacagagcacaggaacagccttgacagtctgtaattattgtacagatattttaatagcatataaataagtatattccttttattttgaaacaaaaatgatcagacactgccttttgtgtgtttgctgcctgtggcatccttttttaaaaagactgttacatattaaaatagtgtacatatataaatattacctcttttgctgtacagttgtgatagagactgaagattttattttttgtgtgctttttataagaaaaaaattaatacactaaagaatcttgctgatgtgattgtaatgtacctatgtaacttatttacttttgaatgttcttctgtatctttaaaccttttattaaataaggttttaaaaattca

SEQ ID NO: 129470 - DNA, 2633 bp, Homo sapiens
  Payload ID: 5322
  Gene Symbol: ELMSAN1
  Gene Name: ELM2 and Myb/SANT-like domain containing 1
  ENST ID: ENST00000451078
  CDS Start-End: 1-1338
gtgcgaccaatgatgccacagaaggtgcagctggaggtagggcggccccaggcacccctgaattctttccacgcagccaagaaacccccaaaccagtcactgcccctgcaacccttccagctggcattcggccaccaggtgaaccggcaggtcttccggcagggcccaccgcccccaaacccggtggctgccttccctccacagaagcagcagcagcagcagcaaccacagcagcagcagcagcagcagcaggcagccctaccccagatgccgctctttgagaacttctattccatgccgcagcaaccctcgcagcaaccccaggactttggcctgcagccagctgggccactgggacagtcccacctggctcaccacagcatggcaccctaccccttcccccccaacccagatatgaacccagaactgcgcaaggcccttctgcaggactcagccccgcagccagcgctacctcaggtccagatccccttcccccgccgctcccgccgcctctctaaggagggtatcctgcctcccagcgccctggatggggctggcacccagcctgggcaggaggccactggcaacctgttcctacatcactggcccctgcagcagccgccacctggctccctggggcagccccatcctgaagctctgggattcccgctggagctgagggagtcgcagctactgcctgatggggagagactagcacccaatggccgggagcgagaggctcctgccatgggcagcgaggagggcatgagggcagtgagcacaggggactgtgggcaggtgctacggggcggagtgatccagagcacgcgacggaggcgccgggcatcccaggaggccaatttgctgaccctggcccagaaggctgtggagctggcctcactgcagaatgcaaaggatggcagtggttctgaagagaagcggaaaagtgtattggcctcaactaccaagtgtggggtggagttttctgagccttccttagccaccaagcgagcacgagaagacagtgggatggtacccctcatcatcccagtgtctgtgcctgtgcgaactgtggacccaactgaggcagcccaggctggaggtcttgatgaggacgggaagggtcctgaacagaaccctgctgagcacaagccatcagtcatcgtcacccgcaggcggtccacccgaatccccgggacagatgctcaagctcagaaaaagtttgctgacttctgccctagaggagatgataaaaagggcttttggacctgctccttttttcaggcttgccttggtgggtgtggtaggcagactaagttccaaaggcagaggacatgaatgtcaagttggagggggagccttccgtgcggaaaccaaagcagcggcccaggcccgagcccctcatcatccccaccaaggcgggcactttcatcgcccctcccgtctactccaacatcaccccataccagagccacctgcgctctcccgtgcgcctagctgaccacccctctgagcggagctttgagctacctccctacacgccgccccccatcctcagccctgtgcgggaaggctctggcctctacttcaatgccatcatatcaaccagcaccatccctgcccctcctcccatcacgcctaagagtgcccatcgcacgctgctccggactaacagtgctgaagtaaccccgcctgtcctctctgtgatgggggaggccaccccagtgagcatcgagccacggatcaacgtgggctcccggttccaggcagaaatccccttgatgagggaccgtgccctggcagctgcagatccccacaaggctgacttggtgtggcagccatgggaggacctagagagcagccgggagaagcagaggcaagtggaagacctgctgacagccgcctgctccagcattttccctggtgctggcaccaaccaggagctggccctgcactgtctgcacgaatccagaggagacatcctggaaacgctgaataagctgctgctgaagaagcccctgcggccccacaaccatccgctggcaacttatcactacacaggctctgaccagtggaagatggccgagaggaagctgttcaacaaaggcattgccatctacaagaaggatttcttcctggtgcagaagctgatccagaccaagaccgtggcccagtgcgtggagttctactacacctacaagaagcaggtgaaaatcggccgcaatgggactctaacctttggggatgtggatacgagcgatgagaagtcggcccaggaagaggttgaagtggatattaagacttcccaaaagttcccaagggtgcctcttcccagaagagagtccccaagtgaagagaggctggagcccaagagggaggtgaaggagcccaggaaggagggggaggaggaggtgccagagatccaagagaaggaggagcaggaagaggggcgagagcgcagcaggcgggcagcggcagtcaaagccacgcagacactacaggccaatgagtcggccagtgacatcctcatcctccggagccacgagtccaacgcccctgggtctgccggtggccaggcctcggagaagccaagggaagggacagggaagtcacgaagggcactacctttttca

SEQ ID NO: 129471 - DNA, 558 bp, Homo sapiens
  Payload ID: 5322
  Gene Symbol: ELMSAN1
  Gene Name: ELM2 and Myb/SANT-like domain containing 1
  ENST ID: ENST00000421708
  CDS Start-End: 362-558
aaagcttggatggagagagtgagctacagtaggcttgtagctggccagaaggggcttctctctaaagccgctcagcttctctggggaattggaatccagacaagaaggaaaatggtgccagaaccctgtggagcatcatgaactgggaagagtagctgagccccagagcctctctggaagagaaaggaagagccagcagttctttctcccagtgtccgacctcactgtccagcgtcttcctctgcccctgctctgccctccctggctcctggactagagcccggcttccagcaggacgtttccccaggggatgggcgactgttgaaggggatctcaccgccagggctcagttggccacatcatgaacctccaggcccagcccaaggctcagaacaagcggaagcgttgcctcttcgggggccaggaaccagctcccaaggagcagccccctcccctgcagcccccccagcagtccatcagagtgaaggaggagcagtacctcgggcacgagggtccaggaggggcagtctccacctctcagcctgtggaactgccccc

SEQ ID NO: 129472 - DNA, 3839 bp, Homo sapiens
  Payload ID: 5322
  Gene Symbol: ELMSAN1
  Gene Name: ELM2 and Myb/SANT-like domain containing 1
  ENST ID: ENST00000435371
  CDS Start-End: 784-3839
gatgaagtggtagagctggttcctgctcgccgcggtgccgcgcgcgccggccggccgctgggcgctccgcgctcccagcctcgagttgtgcaatcctttgtagcacgccagagtcctcctcctccgctgttgcctctcgccctctctctttttttttttttcaagctgtgagctcaaccgatgagtcagagccgtgcaatcctgacactgcatcgcaggactgggggtgacacggagggaggcagagcgctcgcgaggcggacggcacgggtgcggggcgcgccgaggctcctgcatcgcaagcggggggtgacagcccgcgcgtcccgcccgggccctgccagcaaacttctcagcctcgggaggcgcgggctggcggaagccccgcgagcgccgcggggaggcgacggcgcctgtttgtttttaaaatcgggagtgcgtgcaggcggctggagtcccggaggcgaccgaaggcggcgacccgcggcggaagggggacagccgagcccggagcccggagcccgggcaagagctgggtgccagaaccctgtggagcatcatgaactgggaagagtagctgagccccagagcctctctggaagagaaaggaagagccagcagttctttctcccagtgtccgacctcactgtccagcgtcttcctctgcccctgctctgccctccctggctcctggactagagcccggcttccagcaggacgtttccccaggggatgggcgactgttgaaggggatctcaccgccagggctcagttggccacatcatgaacctccaggcccagcccaaggctcagaacaagcggaagcgttgcctcttcgggggccaggaaccagctcccaaggagcagccccctcccctgcagcccccccagcagtccatcagagtgaaggaggagcagtacctcgggcacgagggtccaggaggggcagtctccacctctcagcctgtggaactgccccctcctagcagcctggccctgctgaactctgtggtatatgggcctgagcggacctcagcagccatgctgtcccagcaggtggcctcagtaaagtggcccaactctgtgatggctccagggcggggcccggagcgtggaggaggtgggggtgtcagtgacagcagctggcagcagcagccaggccagcctccaccccattcaacatggaactgccacagtctgtccctctacagtgcaaccaaggggagcccgcatcctggagtgggagtcccgacttactataaccaccctgaggcactgaagcgggagaaagcggggggcccacagctggaccgctatgtgcgaccaatgatgccacagaaggtgcagctggaggtagggcggccccaggcacccctgaattctttccacgcagccaagaaacccccaaaccagtcactgcccctgcaacccttccagctggcattcggccaccaggtgaaccggcaggtcttccggcagggcccaccgcccccaaacccggtggctgccttccctccacagaagcagcagcagcagcagcaaccacagcagcagcagcagcagcagcaggcagccctaccccagatgccgctctttgagaacttctattccatgccgcagcaaccctcgcagcaaccccaggactttggcctgcagccagctgggccactgggacagtcccacctggctcaccacagcatggcaccctaccccttcccccccaacccagatatgaacccagaactgcgcaaggcccttctgcaggactcagccccgcagccagcgctacctcaggtccagatccccttcccccgccgctcccgccgcctctctaaggagggtatcctgcctcccagcgccctggatggggctggcacccagcctgggcaggaggccactggcaacctgttcctacatcactggcccctgcagcagccgccacctggctccctggggcagccccatcctgaagctctgggattcccgctggagctgagggagtcgcagctactgcctgatggggagagactagcacccaatggccgggagcgagaggctcctgccatgggcagcgaggagggcatgagggcagtgagcacaggggactgtgggcaggtgctacggggcggagtgatccagagcacgcgacggaggcgccgggcatcccaggaggccaatttgctgaccctggcccagaaggctgtggagctggcctcactgcagaatgcaaaggatggcagtggttctgaagagaagcggaaaagtgtattggcctcaactaccaagtgtggggtggagttttctgagccttccttagccaccaagcgagcacgagaagacagtgggatggtacccctcatcatcccagtgtctgtgcctgtgcgaactgtggacccaactgaggcagcccaggctggaggtcttgatgaggacgggaagggtcctgaacagaaccctgctgagcacaagccatcagtcatcgtcacccgcaggcggtccacccgaatccccgggacagatgctcaagctcaggcagaggacatgaatgtcaagttggagggggagccttccgtgcggaaaccaaagcagcggcccaggcccgagcccctcatcatccccaccaaggcgggcactttcatcgcccctcccgtctactccaacatcaccccataccagagccacctgcgctctcccgtgcgcctagctgaccacccctctgagcggagctttgagctacctccctacacgccgccccccatcctcagccctgtgcgggaaggctctggcctctacttcaatgccatcatatcaaccagcaccatccctgcccctcctcccatcacgcctaagagtgcccatcgcacgctgctccggactaacagtgctgaagtaaccccgcctgtcctctctgtgatgggggaggccaccccagtgagcatcgagccacggatcaacgtgggctcccggttccaggcagaaatccccttgatgagggaccgtgccctggcagctgcagatccccacaaggctgacttggtgtggcagccatgggaggacctagagagcagccgggagaagcagaggcaagtggaagacctgctgacagccgcctgctccagcattttccctggtgctggcaccaaccaggagctggccctgcactgtctgcacgaatccagaggagacatcctggaaacgctgaataagctgctgctgaagaagcccctgcggccccacaaccatccgctggcaacttatcactacacaggctctgaccagtggaagatggccgagaggaagctgttcaacaaaggcattgccatctacaagaaggatttcttcctggtgcagaagctgatccagaccaagaccgtggcccagtgcgtggagttctactacacctacaagaagcaggtgaaaatcggccgcaatgggactctaacctttggggatgtggatacgagcgatgagaagtcggcccaggaagaggttgaagtggatattaagacttcccaaaagttcccaagggtgcctcttcccagaagagagtccccaagtgaagagaggctggagcccaagagggaggtgaaggagcccaggaaggagggggaggaggaggtgccagagatccaagagaaggaggagcaggaagaggggcgagagcgcagcaggcgggcagcggcagtcaaagccacgcagacactacaggccaatgagtcggccagtgacatcctcatcctccggagccacgagtccaacgcccctgggtctgccggtggccaggcctcggagaagccaagggaagggacagggaagtcacgaagggcactacctttttc

SEQ ID NO: 129473 - DNA, 3483 bp, Homo sapiens
  Payload ID: 5322
  Gene Symbol: ELMSAN1
  Gene Name: ELM2 and Myb/SANT-like domain containing 1
  Uniprot ID: Q6PJG2
  ENST ID: ENST00000423556
  CDS Start-End: 248-3382
gtgccagaaccctgtggagcatcatgaactgggaagagtagctgagccccagagcctctctggaagagaaaggaagagccagcagttctttctcccagtgtccgacctcactgtccagcgtcttcctctgcccctgctctgccctccctggctcctggactagagcccggcttccagcaggacgtttccccaggggatgggcgactgttgaaggggatctcaccgccagggctcagttggccacatcatgaacctccaggcccagcccaaggctcagaacaagcggaagcgttgcctcttcgggggccaggaaccagctcccaaggagcagccccctcccctgcagcccccccagcagtccatcagagtgaaggaggagcagtacctcgggcacgagggtccaggaggggcagtctccacctctcagcctgtggaactgccccctcctagcagcctggccctgctgaactctgtggtatatgggcctgagcggacctcagcagccatgctgtcccagcaggtggcctcagtaaagtggcccaactctgtgatggctccagggcggggcccggagcgtggaggaggtgggggtgtcagtgacagcagctggcagcagcagccaggccagcctccaccccattcaacatggaactgccacagtctgtccctctacagtgcaaccaaggggagcccgcatcctggagtgggagtcccgacttactataaccaccctgaggcactgaagcgggagaaagcggggggcccacagctggaccgctatgtgcgaccaatgatgccacagaaggtgcagctggaggtagggcggccccaggcacccctgaattctttccacgcagccaagaaacccccaaaccagtcactgcccctgcaacccttccagctggcattcggccaccaggtgaaccggcaggtcttccggcagggcccaccgcccccaaacccggtggctgccttccctccacagaagcagcagcagcagcagcaaccacagcagcagcagcagcagcagcaggcagccctaccccagatgccgctctttgagaacttctattccatgccgcagcaaccctcgcagcaaccccaggactttggcctgcagccagctgggccactgggacagtcccacctggctcaccacagcatggcaccctaccccttcccccccaacccagatatgaacccagaactgcgcaaggcccttctgcaggactcagccccgcagccagcgctacctcaggtccagatccccttcccccgccgctcccgccgcctctctaaggagggtatcctgcctcccagcgccctggatggggctggcacccagcctgggcaggaggccactggcaacctgttcctacatcactggcccctgcagcagccgccacctggctccctggggcagccccatcctgaagctctgggattcccgctggagctgagggagtcgcagctactgcctgatggggagagactagcacccaatggccgggagcgagaggctcctgccatgggcagcgaggagggcatgagggcagtgagcacaggggactgtgggcaggtgctacggggcggagtgatccagagcacgcgacggaggcgccgggcatcccaggaggccaatttgctgaccctggcccagaaggctgtggagctggcctcactgcagaatgcaaaggatggcagtggttctgaagagaagcggaaaagtgtattggcctcaactaccaagtgtggggtggagttttctgagccttccttagccaccaagcgagcacgagaagacagtgggatggtacccctcatcatcccagtgtctgtgcctgtgcgaactgtggacccaactgaggcagcccaggctggaggtcttgatgaggacgggaagggtcctgaacagaaccctgctgagcacaagccatcagtcatcgtcacccgcaggcggtccacccgaatccccgggacagatgctcaagctcaggcagaggacatgaatgtcaagttggagggggagccttccgtgcggaaaccaaagcagcggcccaggcccgagcccctcatcatccccaccaaggcgggcactttcatcgcccctcccgtctactccaacatcaccccataccagagccacctgcgctctcccgtgcgcctagctgaccacccctctgagcggagctttgagctacctccctacacgccgccccccatcctcagccctgtgcgggaaggctctggcctctacttcaatgccatcatatcaaccagcaccatccctgcccctcctcccatcacgcctaagagtgcccatcgcacgctgctccggactaacagtgctgaagtaaccccgcctgtcctctctgtgatgggggaggccaccccagtgagcatcgagccacggatcaacgtgggctcccggttccaggcagaaatccccttgatgagggaccgtgccctggcagctgcagatccccacaaggctgacttggtgtggcagccatgggaggacctagagagcagccgggagaagcagaggcaagtggaagacctgctgacagccgcctgctccagcattttccctggtgctggcaccaaccaggagctggccctgcactgtctgcacgaatccagaggagacatcctggaaacgctgaataagctgctgctgaagaagcccctgcggccccacaaccatccgctggcaacttatcactacacaggctctgaccagtggaagatggccgagaggaagctgttcaacaaaggcattgccatctacaagaaggatttcttcctggtgcagaagctgatccagaccaagaccgtggcccagtgcgtggagttctactacacctacaagaagcaggtgaaaatcggccgcaatgggactctaacctttggggatgtggatacgagcgatgagaagtcggcccaggaagaggttgaagtggatattaagacttcccaaaagttcccaagggtgcctcttcccagaagagagtccccaagtgaagagaggctggagcccaagagggaggtgaaggagcccaggaaggagggggaggaggaggtgccagagatccaagagaaggaggagcaggaagaggggcgagagcgcagcaggcgggcagcggcagtcaaagccacgcagacactacaggccaatgagtcggccagtgacatcctcatcctccggagccacgagtccaacgcccctgggtctgccggtggccaggcctcggagaagccaagggaagggacagggaagtcacgaagggcactacctttttcagagaagaagaaaaaaacagagacattcagtaagacccagaatcaggagaacactttcccctgtaaaaaatgtggcagggtgttttacaaggtgaagagccgcagtgcgcatatgaagagccacgcagagcaggagaagaaggctgcagcgctgaggctgaaggagaaagaggccgctgc

SEQ ID NO: 129474 - DNA, 2852 bp, Homo sapiens
  Payload ID: 5323
  Gene Symbol: ELMOD1
  Gene Name: ELMO/CED-12 domain containing 1
  Uniprot ID: Q8N336
  ENST ID: ENST00000265840
  CDS Start-End: 266-1270
cccttccgcgcccgcagccagtgcggcagccgcggccgcccctgtccagcctcggcgcccgggaccgagcgcgtcgctcgccgccgcggagcgcgtagccggagcgcctggggaaggcggagatgaagaccacgccgccgcgcgccgggagctgctgagcctaccgccgccagagtccagttgacacttactttgacaaaggcaaatttggaagcaattacttgaggacagttcatatagcatctggacagtcaacacgggcaccatgaagcacttcctgagaatgttgatccaggtatgcctgtatttttactgtaaatttctgtggcgctgcctgaaatttgtaatgaggaagctaactggaagatgtgaactacaacggatctgttataataccaagccgggagcttctagaaccatgaaaatcgaaacatcactgagggattctaaaagtaagctgttgcagacttctgtgagtgttcaccccgacgctattgaaaaaactatagaagatatcatggaactgaaaaaaattaatcctgacgtaaatccacagctgggaatctctcttcaggcttgccttctgcaaatcgttgggtacaggaaccttattgcagatgtggaaaaactgcgtagagaggcctatgattctgataatccccaacatgaagaaatgcttttgaagttatggaaattcttgaagcccaatactccactggaatctcggatttctaagcagtggtgtgaaattggtttccaaggtgatgatcctaaaacagactttcgaggaatgggacttctgggactgtacaatttgcagtatttcgcggaaagggatgccacagcagctcagcaggtcctgtctgactctcttcatccgaaatgcagggatatcactaaagaagaaataagcaaattcagcaaagcagaatgggagaagaaaaggatggataaggcaattgggtactcatttgcaattgtgggcatcaatataactgacctggcatataatctactggtcagcggagctctaaaaacccatttctacaatatcgccccagaagctccaacattgtctcactttcagcaaacattctgctatttgatgcatgaatttcataagttttggatcgaagaggaccccatggacataatggaatttaatcgtgtgagggagaaattccgcaagaggatcatcaaacagctgcagaacccagacatggcgctgtgcccacattttgctgcctcggaaggtttaatcaacatgtagttgcccacgccggttttaatggataccctggaacactgcctcattgtcttgttagatctctgcttaggtcgcagctcacgcattgaatgcacacagtgattgtatgcatgccttttggtacagtgttttcatctcttggtcataattccgagatccccagagaccactgtttctggagtatctgtcatccagtgactgctcatattgtggcattatgcagtgttacatcttgccttgatacccaggtatggagagagttttctatttttttagactttttttcctctccctcataattcagcattaaagaattgtatttctctagctgtattttgtatgtaagaggtttagctgaatctcattctgtgaaagccttttaatttattgaaatgtttcatgactactgctgctagctcttcaagccaggttcatgcttggacctcattctgataaagtataagactttaaaataatacaaaacagggccgggcgcagtggctcacacctgtaatcccagcactttggggagctgaggcgggcggatcacgaggtcaagagatcgagaccatcctggccaacatggtgaaaccccgtctctactaaaaataacaaaaattagctgggcgtggtggtgggtgcctgtaatcccagctactcgggaggctgaggcaggagaatcgcttgaacccgggaggtggaggttacagtgagccgagatcataccactgcactccagcctggcgacagagcaagactccatctcaaaaataaataaataaataaataaataaataaataaataaataaataaataaataaaatagtacagacagacacatgataagccaaactgttcctgcaaacatagctatgcttcatgaggcttacaagaagtaactttaggtaggagctgtttttgtttgaagtactgcaaaattatattgtaacttcccctcaccccagttgcaattgtgtcatagtcatctgtatatcaaactattttattcccataacttcattggcttggatgcctaagtgtatgatgcttgaagcctcagaaaagaaataagcatatttcaaaagctgcaaaaggtttttcactgcctgcctcttgcggaactgggttacaccctggcactgttctgatccaagcatatttgcttggggaactaagtgctgactagtttgttttctatgtcaaggggcaatattaaaaaacaatttgcaagaaaatgtgtttcaagagagcaacctaagctaagtcactctgcgatatttcttgaaaataacgaccttgtcttgtatcagtggaagaagtaagttgcttagaaagggaaaagtcaaattgttccagaactgctaaaaatcattttaaaaaccatgatttagtttggaattatgattgtagtctgttgaatagtatttaccatggcatttcatacccatggtattttataccttctgactatcaattttagtattattagatgtttgtgtaaccacttgcttatttaaatgaattttgagtactgcctaattgtcagttatatgaataaattacatgtcattctactgtaacgta

SEQ ID NO: 129475 - DNA, 1990 bp, Homo sapiens
  Payload ID: 5323
  Gene Symbol: ELMOD1
  Gene Name: ELMO/CED-12 domain containing 1
  Uniprot ID: Q8N336
  ENST ID: ENST00000443271
  CDS Start-End: 247-1227
agtgcggcagccgcggccgcccctgtccagcctcggcgcccgggaccgagcgcgtcgctcgccgccgcggagcgcgtagccggagcgcctggggaaggcggagatgaagaccacgccgccgcgcgccgggagctgctgagcctaccgccgccagagtccagttgacacttactttgacaaaggcaaatttggaagcaattacttgaggacagttcatatagcatctggacagtcaacacgggcaccatgaagcacttcctgagaatgttgatccaggtatgcctgtatttttactgtaaatttctgtggcgctgcctgaaatttgtaatgaggaagctaactggaagatgtgaactacaacggatctgttataataccaagccgggagcttctagaaccatgaaaatcgaaacatcactgagggattctaaaagtaagctgttgcagacttctgtgagtgttcaccccgacgctattgaaaaaactatagaagatatcatggaactgaaaaaaattaatcctgacgtaaatccacagctgggaatctctcttcaggcttgccttctgcaaatcgttgggtacaggaaccttattgcagatgtggaaaaactgcgtagagaggcctatgattctgataatccccaacatgaagaaatgcttttgaagttatggaaattcttgaagcccaatactccactggaatctcggatttctaagcagtggtgtgaaattggtttccaaggtgatgatcctaaaacagactttcgaggaatgggacttctgggactgtacaatttgcagtatttcgcggaaagggatgccacagcagctcagcaggtcctgtctgactctcttcatccgaaatgcagcaaattcagcaaagcagaatgggagaagaaaaggatggataaggcaattgggtactcatttgcaattgtgggcatcaatataactgacctggcatataatctactggtcagcggagctctaaaaacccatttctacaatatcgccccagaagctccaacattgtctcactttcagcaaacattctgctatttgatgcatgaatttcataagttttggatcgaagaggaccccatggacataatggaatttaatcgtgtgagggagaaattccgcaagaggatcatcaaacagctgcagaacccagacatggcgctgtgcccacattttgctgcctcggaaggtttaatcaacatgtagttgcccacgccggttttaatggataccctggaacactgcctcattgtcttgttagatctctgcttaggtcgcagctcacgcattgaatgcacacagtgattgtatgcatgccttttggtacagtgttttcatctcttggtcataattccgagatccccagagaccactgtttctggagtatctgtcatccagtgactgctcatattgtggcattatgcagtgttacatcttgccttgatacccaggtatggagagagttttctatttttttagactttttttcctctccctcataattcagcattaaagaattgtatttctctagctgtattttgtatgtaagaggtttagctgaatctcattctgtgaaagccttttaatttattgaaatgtttcatgactactgctgctagctcttcaagccaggttcatgcttggacctcattctgataaagtataagactttaaaataatacaaaacagggccgggcgcagtggctcacacctgtaatcccagcactttggggagctgaggcgggcggatcacgaggtcaagagatcgagaccatcctggccaacatggtgaaaccccgtctctactaaaaataacaaaaattagctgggcgtggtggtgggtgcctgtaatcccagctactcgggaggctgaggcaggagaatcgcttgaacccgggaggtggaggttacagtgagccgagatcataccactgcactccagcctggcgacagagcaagactccatctc

SEQ ID NO: 129476 - DNA, 1832 bp, Homo sapiens
  Payload ID: 5323
  Gene Symbol: ELMOD1
  Gene Name: ELMO/CED-12 domain containing 1
  ENST ID: ENST00000531234
  CDS Start-End: 559-1545
agccgcccgcttcgtgctcccagggaagcctctgcacgccctcccccgctgctctcggtcgcctcctcgccgccagccgccccgggtgcatcccggcttgctccgctccacgcgacccagattcctgccccgcccccgccccttccgcgcccgcagccagtgcggcagccgcggccgcccctgtccagcctcggcgcccgggaccgagcgcgtcgctcgccgccgcggagcgcgtagccggagcgcctggggaaggcggagatgaagaccacgccgccgcgcgccgggagctgctgagcctaccgccgccagagtccagttgacacttactttgacaaaggcaaatttggaagcaattacttgaggacagttcatatagcatctggacagtcaacacgggcaccatgaagcacttcctgaggatttcttcaagcaagaattaactttcattagcacattcattgaaactgttcaaaataagccacttttctcttactgttccaaaagaagacgtcagagtcacaaatttaggatgatggcatagtgttgcattacagaatgttgatccaggtatgcctgtatttttactgtaaatttctgtggcgctgcctgaaatttgtaatgaggaagctaactggaagatgtgaactacaacggatctgttataataccaagccgggagcttctagaaccatgaaaatcgaaacatcactgagggattctaaaagtaagctgttgcagacttctgtgagtgttcaccccgacgctattgaaaaaactatagaagatatcatggaactgaaaaaaattaatcctgacgtaaatccacagctgggaatctctcttcaggcttgccttctgcaaatcgttgggtacaggaaccttattgcagatgtggaaaaactgcgtagagaggcctatgattctgataatccccaacatgaagaaatgcttttgaagttatggaaattcttgaagcccaatactccactggaatctcggatttctaagcagtggtgtgaaattggtttccaaggtgatgatcctaaaacagactttcgaggaatgggacttctgggactgtacaatttgcagtatttcgcggaaagggatgccacagcagctcagcaggtcctgtctgactctcttcatccgaaatgcagggatatcactaaagaagaaataagcaaattcagcaaagcagaatgggagaagaaaaggatggataaggcaattgggtactcatttgcaattgtgggcatcaatataactgacctggcatataatctactggtcagcggagctctaaaaacccatttctacaatatcgccccagaagctccaacattgtctcactttcagcaaacattctgctatttgatgcatgaatttcataagttttggatcgaagaggaccccatggacataatggaatttaatcgtgtgagggagaaattccgcaagaggatcatcaaacagctgcagaacccagacatggcgctgtgcccacattttgctgcctcggaaggtttaatcaacatgtagttgcccacgccggttttaatggataccctggaacactgcctcattgtcttgttagatctctgcttaggtcgcagctcacgcattgaatgcacacagtgattgtatgcatgccttttggtacagtgttttcatctcttggtcataattccgagatccccagagaccactgtttctggagtatctgtcatccagtgactgctcatattgtggcattatgcagtgttacatcttgccttgatacccaggtatggagagagttttctatttttttagactttttttcctct

SEQ ID NO: 129477 - DNA, 4409 bp, Homo sapiens
  Payload ID: 5324
  Gene Symbol: ELMOD2
  Gene Name: ELMO/CED-12 domain containing 2
  Uniprot ID: Q8IZ81
  ENST ID: ENST00000323570
  CDS Start-End: 133-1014
ctcgctccctgacttccgggtcgcggtgcttgaagggagtgttccgtcgtttccgttgccggctgtttgcagtggggaaaccgaggcagctcctgctccccctagttcttccgctcctgtgaggaaaaaaaaatgtttatttctttgtgggagttcttctatgggcacttttttcgattttggatgaaatggctattacgacagatgactgggaagtgtgaattgcagcgaatatttgatacctatgtaggtgcacaaaggacacacaggatagaaaattccttgacatactccaagaataaggttttacagaaggcgacacatgttgttcagagtgaagtggacaaatatgtagatgatattatgaaggaaaagaatattaaccctgagaaggatgccagttttaaaatatgcatgaagatgtgcttactgcagataactggttataaacagctgtatttggatgtagaaagtgtgaggaaaaggccatatgattctgataacctacagcatgaagagctactcatgaagctttggaatcttctaatgcccacgaagaagttaaacgctagaatctccaagcagtgggctgaaattggttttcagggtgatgatcccaagacagacttcagaggcatgggcatacttgggttaatcaatcttgtgtatttcagtgaaaattacactagtgaagctcatcagattctttcccgttcaaatcatccaaaattagggtattcttatgcaatagttggaatcaatcttacagagatggcttatagcttactgaagagtgaagctttgaagtttcatctctataaccttgttcctggtataccaacaatggaacactttcatcagttttactgttatcttgtctatgaatttgacaagttttggtttgaagaagaaccagaaagcattatgtatttcaatttgtatagagagaagtttcatgaaaagattaaaggacttttactggattgtaatgtagcacttactttaaaagtataaatcatccactgtatcttctatttctaccacattttgcacattcaacagaatttatatgttgtaataggaattatctgatcaattacactcttatatataatttcctacaaaaatatttcagaaattctatttaagaaagctagtggacaatcagtgtatgtttacaattgtttatacactgttctccaaaggtaccttatccttccaaagatcccctctgtagagtcatgcgaactacagtttggaacttgggacttagcccgttggtgtaaaagtataaatcaggtatttgtattaaattgattaaaatgtgtaaaatcaattttcgtttttatgtgttatagggtcaagttggtatctttttcaaagctctttaagatttttttggtttttagtttggaaatggctgtttttaattttgtctgatttttatttctaggttaattaacagcaagtgtttctttatggttttctttgtttgcatcttaattacatgtcataacgttgcttcattagtagcaaatagagcagagatacagcagagagaataaagaattagggcctccttttgggtttctgtgattattgagcataactgatgagagaatgacagtattggtgactagcttttttgtttttaaataacacactttaaaatgccacagtgttatttgaaagcttaaaggcattttctcatcttcagtatttgctttttatcagttgtagaaaagaaccttagtgttttcttctctacctatgtatgcttatgaaaccgctctacctacatatgaaacttctctacctatgtatgtttacgaaaagagatgtatttgccaagaaaatcttgattatataaaagacaaaaagattataaaagacagtttctgtttaagtaaaactgtctttgaaacttaagaaagcttaagttttaaaaaaatctcagttaaacatcattggtttatttgacttactgttaactcttgcttctctttgactccatggtgtttttagataaccatgtatgaactttatgttaatggtttgtgggatactaaaatagcttgaagatgacttgatgactgtgcattttatatagttttattctcctaaaatctcaggagggcagcaagtgctgtcaacgattatatagtgatgagatttttatgggaatgatttcttcttggtgcgttttacacatttgtactgatagcaaaactaaagtttaaagcagcaaagtttaagttctccttaaatcctacagaaaccaaccttttaaggacataatttcatctaaaacatgacgatatttagcacaccttttaatgtgggtatatatcaagtgtttaaggactggctagtatgtgatagagcaagacctgagactttataagtatttgctcgtgtctgttgacagacctctttctttcaaacttgttagaagagtggtaagacatatccaattggaaaataagatgcagtgttgtatagcacatacatttaaagtgcttgcgttaaaattagtttctcaataagataaaattattttaaaaatttggttcactttattacaatagtggcaatttagcttttcagtattacaggaatttaaaaattggtttcttgtaggggacatctcaactttgggaatatcttcacttaatttttaaaaaatattttcatgctttattgtccagctatacaatatgtcgcaaaatcctgacaagttcattgtattaaggtattaactattacatggaaagcaattctgttcatcttttgatgtttgtgttgaaaatgcttatctttgtgttttgatcttccaacagctgagagcttgaactgatttaaacatttgtcaatatacttaagaatgctttaagtaaagaaggggaaaattttaagtaagttttttcccttctaggaagaaaaactatgatgatgttaagaaaatgtcattatagagcttgctcaataatatgttctttaaatccacctccatttgtacattataggtatcattctgtttttgcttaaaataatctgcaaccatttcagatagttttacagcaaattgatctaaaagccactaataaattctagggtttgagtctagaagccaagcaaactgtcaccaatgtcagttgtaaattagaatgcaacatgaggcttcagactcatgacaatgatatacatgaaaacaaaaatataattgtgtctaccttcctactttcccttttgacatatgtagttggaattttacatagtcttaaaatccatatttagaatcttacctgtttctataataattagtaaaatgccaaagtagtgatagaatattgtggcattgaagtagccgaaaaattgttagttttagcatcaaaaaagtaaatagatgttgaaatgaatttttgtatgtgccaggttgaagagagtgtgccagtgacaggaagtagtctaaaaaattaacagttatggttttaataggatctgaaagacaatctttaaagaaatgggagaaattgggggtatcagtgaacctataccaacctctctttgtacataaatatggtgatgtagctagatataaaaatcagtgtcttactggcaccatttacagtttagaaaacaatctttttcttaaaaatgcccatctgatttctatttttaggagctacttggatttgtatgtattttttctacgtgaaaatatatgtactcttcacttttgttccagtactataattgctcatgcactctttctcccctttgagaacattcagtgaaatacaacttcatcaaagatttgctcaaaggagaagaatcgcatgagtgtgaaaagtagatgctcgtagccagaacagaaaaggttacacatgatcatggcacagaagataggaggtttgacttggtgggccataatgtttattatcctttttgaaataacagggaccagcagcagttttctcaggataaatgctctaccccacttctctatgaacaggtgtggggaggcttactttccattttcatatttatacacctctctacaaaagcaatttttaatgaaggttagtggaattgttaaaaatctgagaggaatgatgactggaggtgtttggggtttttttctgtattcattttttaatgagaaaagttttaaatgtagtacaggttagacccaactactaccttactattataggacgattctatgtttctgttaaagtattcaagtagctttctctgggggaaaaagtaccacttggacacttaaaggaattgggatttttgtctactttggataaggcagttgacttcttaagtaaaagcaatagtgtaaaatgtcattttgtttggaatgttaagtgagcaaataaaaaacatgttgaaattgt

SEQ ID NO: 129478 - DNA, 738 bp, Homo sapiens
  Payload ID: 5324
  Gene Symbol: ELMOD2
  Gene Name: ELMO/CED-12 domain containing 2
  ENST ID: ENST00000502397
  CDS Start-End: 236-738
gcgcgaggggggtcggcgcagagacgcccagagccctggggtgctcaggcgccgctacgcgtgcatcccctctgctcggcagttctgcgcttttgtcctaatgagcgcggactagatggcttgattttcaagataatgatcaacccagctgtgctatgcgctctttctgcactgacctgcgggtacttcgaacttcgacagtccctcctcaggccctagtccagaggaaaaaaaaatgtttatttctttgtgggagttcttctatgggcacttttttcgattttggatgaaatggctattacgacagatgactgggaagtgtgaattgcagcgaatatttgatacctatgtaggtgcacaaaggacacacaggatagaaaattccttgacatactccaagaataaggttttacagaaggcgacacatgttgttcagagtgaagtggacaaatatgtagatgatattatgaaggaaaagaatattaaccctgagaaggatgccagttttaaaatatgcatgaagatgtgcttactgcagataactggttataaacagctgtatttggatgtagaaagtgtgaggaaaaggccatatgattctgataacctacagcatgaagagctactcatgaagctttggaatcttctaatgcccacgaagaagttaaacgctagaatctccaagcagtgggctgaaattggttttcagggtgatgatcccaagacagacttcagagg

SEQ ID NO: 129479 - DNA, 594 bp, Homo sapiens
  Payload ID: 5324
  Gene Symbol: ELMOD2
  Gene Name: ELMO/CED-12 domain containing 2
  ENST ID: ENST00000507667
  CDS Start-End: 490-594
ggtgcttgaagggagtgttccgtcgtttccgttgccggctgtttgcagtggggaaaccgaggcagctcctgctccccctagttcttccgctcctgtgaggtggctgctgtttcttttcctcttgccccggatgcctcggtgcggctgcactgagagcgcgcgggctcgcgagccccgcggggttctgcgggaacccgggggcgcctgggccggcgggtctttgtgcgagccctgccctcccattcgcgggcggcgcgcgaggggggtcggcgcagagacgcccagagccctggggtgctcaggcgccgctacgcgtgcatcccctctgctcggcagttctgcgcttttgtcctaatgagcgcggactagatggcttgattttcaagataatgatcaacccagctgtgctatgcgctctttctgcactgacctgcgggtacttcgaacttcgacagtccctcctcaggccctagtccagaggaaaaaaaaatgtttatttctttgtgggagttcttctatgggcacttttttcgattttggatgaaatggctattacgacagatgactgggaagtgtgaattgcagcgaatattt

SEQ ID NO: 129480 - DNA, 535 bp, Homo sapiens
  Payload ID: 5324
  Gene Symbol: ELMOD2
  Gene Name: ELMO/CED-12 domain containing 2
  ENST ID: ENST00000513606
  CDS Start-End: 246-535
agacgctgcctcatagcagctggttgattaagtttaattactttcctagttttcttacaacttcatggttgacttaaattattgctgctcttttaatttgcccttttgactactcaaaagaacaaagtacctcttgataagaaatctcttcaggcaaaaattccttgacatactccaagaataaggttttacagaaggcgacacatgttgttcagagtgaagtggacaaatatgtagatgatattatgaaggaaaagaatattaaccctgagaaggatgccagttttaaaatatgcatgaagatgtgcttactgcagataactggttataaacagctgtatttggatgtagaaagtgtgaggaaaaggccatatgattctgataacctacagcatgaagagctactcatgaagctttggaatcttctaatgcccacgaagaagttaaacgctagaatctccaagcagtgggctgaaattggttttcagggtgatgatcccaagacagacttcagaggcatgggcatacttgggtt

SEQ ID NO: 129481 - DNA, 751 bp, Homo sapiens
  Payload ID: 5324
  Gene Symbol: ELMOD2
  Gene Name: ELMO/CED-12 domain containing 2
  ENST ID: ENST00000511887
  CDS Start-End: 123-302
gacttccgggtcgcggtgcttgaagggagtgttccgtcgtttccgttgccggctgtttgcagtggggaaaccgaggcagctcctgctccccctagttcttccgctcctgtgaggaaaaaaaaatgtttatttctttgtgggagttcttctatgggcacttttttcgattttggatgaaatggctattacgacagatgactgggaagtgtgaattgcagcgaatatttgatacctatgtaggtgcacaaaggacacacaggatagaaaattccttgacatactccaagaataaggtaggataacataaaggtggtaactctagaaaacttaacgtggacatattttttcttaaaaaaaaaaaagtgccctgctagaagagtgttttctatagtgagcattgagtgaaattttccccgtttagaggtaatattctgttttcaaacatttctctatatatgtgtttttcgtgtgtatttcaaagaaaatacttgaataatttgtcctgtcctgaggttttatttgtttattttgctttaagagttgatagcttttaggaaagcagggccttaggaggaaagtcgtcttttagactgtgtcctcaggatagattatatgagagaaaagcaacttaggatagagaaaaccctgggttgtgtaccttttgagctaaaataagtcataattcatgctatgtattagtcagcttttgctgtgtaacaaactataataaaatctcaggggcataaaacga

SEQ ID NO: 129482 - DNA, 2685 bp, Homo sapiens
  Payload ID: 5325
  Gene Symbol: ELMOD3
  Gene Name: ELMO/CED-12 domain containing 3
  Uniprot ID: Q96FG2
  ENST ID: ENST00000315658
  CDS Start-End: 260-1435
ccccaagtttggaaagctcttttaacgagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaaggtgtgctctttcttctggggaggcctaggctgaatgcacagtgtcccaggtccagagagcccaaggtggttgctagactggttttggctgcagttcttccccatccacactttctcaaattccagcttaccaaaatctccatcacccaccccctggagtctgctagttctcctttctctgccctgactgtcgcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 129483 - DNA, 2332 bp, Homo sapiens
  Payload ID: 5325
  Gene Symbol: ELMOD3
  Gene Name: ELMO/CED-12 domain containing 3
  Uniprot ID: Q96FG2
  ENST ID: ENST00000393852
  CDS Start-End: 401-1546
gcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccgagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 129484 - DNA, 2564 bp, Homo sapiens
  Payload ID: 5325
  Gene Symbol: ELMOD3
  Gene Name: ELMO/CED-12 domain containing 3
  Uniprot ID: Q96FG2
  ENST ID: ENST00000409344
  CDS Start-End: 633-1778
ggaagcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccgatagtaactgtccctactgaaggccccaggagtgctccagccaggtgtggaaagctggtcacgattctatgctacttggttcattttctacacagcaacagaagagccctcctgagattgctattaccatacccgcctgtcaccttgccaaggctggccaatgccgagcgtgttggctcatgcctgtaatcccagcactttggaaggccgaggcaggcggatcacgagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 129485 - DNA, 994 bp, Homo sapiens
  Payload ID: 5325
  Gene Symbol: ELMOD3
  Gene Name: ELMO/CED-12 domain containing 3
  ENST ID: ENST00000409331
  CDS Start-End: 387-994
aaatgtagttctcggggccaggggagccggcacggaagcggctgtgcgcatgagcagatgaggcctagccgaggcggcgggacccccaagtttggaaagctcttttaacgatagtaactgtccctactgaaggccccaggagtgctccagccagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcaggg

SEQ ID NO: 129486 - DNA, 2492 bp, Homo sapiens
  Payload ID: 5325
  Gene Symbol: ELMOD3
  Gene Name: ELMO/CED-12 domain containing 3
  Uniprot ID: Q96FG2
  ENST ID: ENST00000409890
  CDS Start-End: 559-1704
ggctatgcgaaagttctgtccaaaggctgctcacagcccctgtctgactggttgtcatgatgaattgagctctctgttacctgcgcatcacaaccgatagtaactgtccctactgaaggccccaggagtgctccagccaggtgtggaaagctggtcacgattctatgctacttggttcattttctacacagcaacagaagagccctcctgagattgctattaccatacccgcctgtcaccttgccaaggctggccaatgtgtgttttgtcataggctgtcatggaggccatgatggaggaaaaggaaaggggaggcagatgttgagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaatt

SEQ ID NO: 129487 - DNA, 1392 bp, Homo sapiens
  Payload ID: 5325
  Gene Symbol: ELMOD3
  Gene Name: ELMO/CED-12 domain containing 3
  Uniprot ID: Q96FG2
  ENST ID: ENST00000410106
  CDS Start-End: 9-566
tttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtgagtgcaatgcgagcccacagggcagttgctgcatctgtggttgggcaagaccgtgtgtgctgaccctgtgaggctaagccaggaatattgcatgtaccatggttggcgggtgagagtgggagctgagaactggatgtctcacagtccagatctcacattctctgagaagcacccggttctcccatgaggggcaatctggcagagagtgtgggtgtgttttggggcaggtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgag

SEQ ID NO: 129488 - DNA, 2413 bp, Homo sapiens
  Payload ID: 5325
  Gene Symbol: ELMOD3
  Gene Name: ELMO/CED-12 domain containing 3
  Uniprot ID: Q96FG2
  ENST ID: ENST00000409013
  CDS Start-End: 482-1627
aaatgtagttctcggggccaggggagccggcacggaagcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccgatagtaactgtccctactgaaggccccaggagtgctccagccagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 129489 - DNA, 1209 bp, Homo sapiens
  Payload ID: 5325
  Gene Symbol: ELMOD3
  Gene Name: ELMO/CED-12 domain containing 3
  ENST ID: ENST00000418268
  CDS Start-End: 850-1209
aataatcaaagcatcctgacaccagcagccagtttttatggcatcctggagggctgacctcatagagaggctaccctccttccttagtcacccaaagttgtgaactatgattgtcagttgtgtgtgggccatctgcccacttaggatgcaatttttgatgtgacagacattccggatgtccaattcccctgtgatgaggtatgagccttgtccagcccttttcctgagggaagcaatgtcagatgaaagacttagaattgcccaaactggctagccagctgccacatgcacagtattgctgataactgagaaaggttagaacatcgtgttgcattttgaatttctaccattgttggaaccaggtctagtattataagcccctgacccagcctgtgtgtgaggcctaaacaaagcctgagcacttcagctaagaccacccaccaaggtgacacctttagcctcacgcctttgataagctggcccaggtcccagtaactccattgtcagaaacagaccccatcccttctagtggtgctgctgccttttggacacagaatccagctcacagtcccctgtgtggtccccttttggccatcctgtggcttgggtagtaagagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaag

SEQ ID NO: 129490 - DNA, 1932 bp, Homo sapiens
  Payload ID: 5325
  Gene Symbol: ELMOD3
  Gene Name: ELMO/CED-12 domain containing 3
  Uniprot ID: Q96FG2
  ENST ID: ENST00000414593
  CDS Start-End: 120-605
ggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaattaa

SEQ ID NO: 129491 - DNA, 559 bp, Homo sapiens
  Payload ID: 5325
  Gene Symbol: ELMOD3
  Gene Name: ELMO/CED-12 domain containing 3
  ENST ID: ENST00000440462
  CDS Start-End: 2-136
catgaatgaaaaatcttgctctttccatagtaaagaagaattaagagatggacagggtgaaagattgtctgctggatattctccatcatatgacaaggacaagagtgttctggctttcagaggaatccctttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtgagtgcaatgcgagcccacagggcagttgctgcatctgtggttgggcaagaccgtgtgtgctgaccctgtgaggctaagccaggaatattgcatgtaccatggttggcgggtgagagtgggagctgagaactggatgtctca

SEQ ID NO: 129492 - DNA, 1414 bp, Homo sapiens
  Payload ID: 5325
  Gene Symbol: ELMOD3
  Gene Name: ELMO/CED-12 domain containing 3
  Uniprot ID: Q96FG2
  ENST ID: ENST00000444108
  CDS Start-End: 9-773
tttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagattgaaagaaatcaagggaagggatgatattatgcaagtatatatgatcattaaataggcaatacctgaaggtacagaggtatacatgaaggtcagcatcaatggtgttctcagctacccatgttgagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggct

SEQ ID NO: 129493 - DNA, 4761 bp, Homo sapiens
  Payload ID: 5325
  Gene Symbol: ELMOD3
  Gene Name: ELMO/CED-12 domain containing 3
  Uniprot ID: Q96FG2
  ENST ID: ENST00000446464
  CDS Start-End: 2208-2972
ccggcacggaagcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccggtgagcgtctgtctctgtgcccctcaaagtggcccatagttttgtcctgggggcccgcctgggacggagtcctctatggcgggtccctaatgacaccccatccgtggggaacctgggggacggggagccgcccatggacaagcatggtgaaaggatcagctaagggcccatctaatttaaattcctatgcagagaatctaacctccagcaagcagttgaagaatcataccccctccttgcctaaagagggtgcataatgaatacttgattggagaaggatccatttttacaggaaggccgtttccttaggtccaactatcaggaatttgcctttgagtacttccttgtttaatggaattgttgctcttttcttctctgctacagatagtaactgtccctactgaaggccccaggagtgctccagccaggtgtggaaagctggtcacgattctatgctacttggttcattttctacacagcaacagaagagccctcctgagattgctattaccatacccgcctgtcaccttgccaaggctggccaatgtgtgttttgtcataggctgtcatggaggccatgatggaggaaaaggaaaggggaggcagatgttgaggccccagaggccacagtgagagcagtttagttcctggggtgccaggactaagggggcattgccctgtcccccggattacagtgagccacatgtcaagcccaagagccaggaggtattcttcctctcagtgttaataatcaaagcatcctgacaccagcagccagtttttatggcatcctggagggctgacctcatagagaggctaccctccttccttagtcacccaaagttgtgaactatgattgtcagttgtgtgtgggccatctgcccacttaggatgcaatttttgatgtgacagacattccggatgtccaattcccctgtgatgaggtatgagccttgtccagcccttttcctgagggaagcaatgtcagatgaaagacttagaattgcccaaactggctagccagctgccacatgcacagtattgctgataactgagaaaggttagaacatcgtgttgcattttgaatttctaccattgttggaaccaggtctagtattataagcccctgacccagcctgtgtgtgaggcctaaacaaagcctgagcacttcagctaagaccacccaccaaggtgacacctttagcctcacgcctttgataagctggcccaggtcccagtaactccattgtcagaaacagaccccatcccttctagtggtgctgctgccttttggacacagaatccagctcacagtcccctgtgtggtccccttttggccatcctgtggcttgggtagtaagaggtaagcatttggctgaggcaagttgttcattcagaataaattcacagctgcttaaattttgtcaacaggccgagcgtgttggctcatgcctgtaatcccagcactttggaaggccgaggcaggcggatcacgaggtcaggagttcaagaccagcctaaccaacatagtgaaaccccatctctactaaaaatacaaaaattagcagggtgtggtggcgcacgcctgtaattccagctactcgggagactgggacaggagaatcgcttgaacccgggaggcggaggttgcagtgagccgagatcgcacggctgcactccagcctgggcaacagggcaagactccaactcaaaaaaaaaaaaaaattgtcaacagaggcataactgaatggtgaaaccagttttctttttcaatttcttttttttcttttgtgcagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagattgaaagaaatcaagggaagggatgatattatgcaagtatatatgatcattaaataggcaatacctgaaggtacagaggtatacatgaaggtcagcatcaatggtgttctcagctacccatgttgagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaaggtgtgctctttcttctggggaggcctaggctgaatgcacagtgtcccaggtccagagagcccaaggtggttgctagactggttttggctgcagttcttccccatccacactttctcaaattccagcttaccaaaatctccatcacccaccccctggagtctgctagttctcctttctctgccctgactgtcgcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaa

SEQ ID NO: 129494 - DNA, 941 bp, Homo sapiens
  Payload ID: 5325
  Gene Symbol: ELMOD3
  Gene Name: ELMO/CED-12 domain containing 3
  ENST ID: ENST00000429764
  CDS Start-End: 456-710
atgagcagatgaggcctagccgaggcggcgggacccccaagtttggaaagctcttttaacgatagtaactgtccctactgaaggccccaggagtgctccagccaggtgtggaaagctggtcacgattctatgctacttggttcattttctacacagcaacagaagagccctcctgagattgctattaccatacccgcctgtcaccttgccaaggctggccaatagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctaaaagaatccagccaactattcgaaggactgggctcgccgccctccgacactacctcttcgggcctccaaagctccaccagcgccttcgggaagaaagggacttggtcctgaccattgctcagtgagcgaatccagccacagacctgagaggcgcaggcttccttgccctcctgcatctgctctacctggtgatggactcaaagaccttgccgatggcgcaggagattttccgcctgtctcgtcaccacatccagattgaaagaaatcaagggaagggatgatattatgcaagtatatatgatcattaaataggcaatacctgaaggtacagaggtatacatgaaggtcagcatcaa

SEQ ID NO: 129495 - DNA, 2216 bp, Homo sapiens
  Payload ID: 5325
  Gene Symbol: ELMOD3
  Gene Name: ELMO/CED-12 domain containing 3
  ENST ID: ENST00000423095
  CDS Start-End: 407-895
acggaagcggctgtgcgcatgagcagatgaggcctagccgaggcggcgggacccccaagtttggaaagctcttttaacggctatgcgaaagttctgtccaaaggctgctcacagcccctgtctgactggttgtcatgatgaattgagctctctgttacctgcgcatcacaaccgagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtattgaaagaaatcaagggaagggatgatattatgcaagtatatatgatcattaaataggcaatacctgaaggtacagaggtatacatgaaggtcagcatcaatggtgttctcagctacccatgttgagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaattaa

SEQ ID NO: 129496 - DNA, 977 bp, Homo sapiens
  Payload ID: 5325
  Gene Symbol: ELMOD3
  Gene Name: ELMO/CED-12 domain containing 3
  ENST ID: ENST00000462891
  CDS Start-End: 599-977
caagtttggaaagctcttttaacgatagtaactgtccctactgaaggccccaggagtgctccagccaggtgtggaaagctggtcacgattctatgctacttggttcattttctacacagcaacagaagagccctcctgagattgctattaccatacccgcctgtcaccttgccaaggctggccaatgtgtgttttgtcataggctgtcatggaggccatgatggaggaaaaggaaaggggaggcagatgttgaggccccagaggccacagtgagagcagtttagttcctggggtgccaggactaagggggcattgccctgtcccccggattacagtgagccacatgtcaagcccaagagccaggagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaacta

SEQ ID NO: 129497 - DNA, 4027 bp, Homo sapiens
  Payload ID: 5326
  Gene Symbol: ELL
  Gene Name: elongation factor RNA polymerase II
  Uniprot ID: P55199
  ENST ID: ENST00000262809
  CDS Start-End: 73-1938
ggcggggcggggcgtggccggcgtggcggcgctggagccgggaagggggcgcgggggagagatggtcgcaagatggcggcgctgaaggaggataggagctacgggctgtcgtgcgggcgggttagcgacggcagcaaggtgtcggtgttccacgtgaagctcaccgacagtgccctgagggccttcgagagctaccgcgccagacaggattctgtttcactgaggccatctatccgatttcaaggaagccaagggcacatctccatcccccagcctgactgccccgcagaggcgcggacgttctccttctacctctccaacatcggccgcgacaacccccagggcagcttcgactgcatccagcagtatgtctccagtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtggccaacatgagtgctaaggacggcacgtgtacactgcaggactgcatgtacaaggatgtgcagaaggactggcctggctactcggagggggaccagcagctgctgaagcgggtgctcgtccggaagctgtgccagccacagagcactggcagcctccttggagaccctgctgcctccagccccccaggcgagcgtgggcgctcggcctcgcccccacagaagcggctgcagcctcctgatttcatcgaccccctagccaacaagaaaccccggatatcgcacttcactcagagagctcagcctgccgtcaacgggaagctgggcgtgcccaatggccgtgaggccttgctgcccaccccgggcccaccagccagcacggacaccctcagctccagcactcacctgcccccgcggctggagcccccgagggcccacgaccccctggccgatgtcagcaatgacctgggccacagcggccgagactgtgagcacggagaggcggctgccccagcccccactgtgcgcctcggcctgcccctgctgacggactgtgcccagcccagcaggccacacggcagcccctcgcgcagcaagcccaagaagaagtccaagaagcacaaagacaaggagagggcggctgaggacaagccccgggcccagcttccagactgtgcacctgccacccatgccacccccggagccccagcagacaccccaggtttaaacggaacctgcagcgtttccagtgttcccacgtccacgtcggagacgcctgactacttgctgaagtacgcagccatctcctcttcggagcagcgccagagctacaagaacgacttcaatgccgagtacagcgagtaccgcgacctgcacgcccgcattgagcgcatcacgcggcggttcacccagctcgacgcccagctccggcagctctcccagggctccgaggagtatgagactactcgagggcagattttgcaggaatatcgaaaaatcaaaaagaccaacaccaactacagccaggagaagcaccgctgcgagtacctgcacagcaagctggcccacatcaagaggctcatcgccgagtacgaccagcggcagctgcaggcttggccctagccgccctccccgatggcggggatctgggagggtcgggggagcaaaaggcggtgagagaggatttatttaaaaaaataaacccgaggaagatgctcatctgagccagcaccgccggctttcagggcagcccctgcagacgtctggccctggcgggtggctgcaagcccacctcggccctccctgcgcttcctgagcagtccctgcttatgatgggctccccaggaagcccactgcctcctccctggctgcagcctccggggttcagcctcctgtctcgccagaagactcctaggcccttggggtggcgcgcctgccttttctagttttatacaaagacagccacttttagctactgctaatgagacttgagtctatttttgtacaaaagagaagcaaaatcttttttctaaacctgtgcctccctctcctcggacacccagggtctagccgctgccctgggtcctgcctgcagtattacagaggtcgtcgaaaggtgcagctgcgttctgagggcgtggggaatgggcaggtggcctctgctggtctctggctctacgtttaggcacccctttccccagcctctcctccttgggcagggtctctgctccagcaagcaaacagggtggcccaggtggctattttgagaactccagctggtgcccccagacagctgctcagagccaagggggcagagggctttcagcgcccccaggcctgccctgctatttcaggccctcagctgtcgggggccactgtgtttctgtgctccaagttgagactcggccgcagcggcgtcagacttttctttgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccagggcatggtggggtctgaggcgtgtgttcccatttagggctgaatgaagccatgacttggaaaggtggtggggggtggatggcggctgtgactcagggcccagggatcacatgggggtcactgctgccatcagcagtcaggcagggagaacagaaatgcaaaaatacagatgtctatttttctaaactggggggtggaggggtgcctcctgacagcttccaaagagctgactgtggagggcccacagtgtatcccacccctgcccgagagtctctctcctttgggacccccgggttcccagagctccgaggaaactgatccttcatgtttcaatagctgttgttgtttttctctttgggccgggccgggccggggaagggccgagcaggctccaggaggcctccagagtcagctggaccttgctgtgtcgcccgcaggcagccctgcagacaccggtgaggtgggatgatttcaggaggtcccagcccgggactgcccgcccctctgccctgggaaccagtccaaggggctgtcagttgaatttgcctttttgttgttgttgttgtttttgttgtttatttgttctccttttaaggaattatgaagctaagaaaagttttgtgttttgggggttggtggacaaagttctagctgattaaatatggtctaacttattgatactatttttttttcttttaatgttgtactgtggagaaaaactattttgagccatggggttggtgtttacaagaactttccacttttgccaaaatgttacaattgaaaggcatctatctgcgtcttcagtttcctgatattttcttaaaagatctagtgtcctttttgtacactaaacaggtgaatgctgacttttttcattctccaataaatttcactgaactgaa

SEQ ID NO: 129498 - DNA, 1852 bp, Homo sapiens
  Payload ID: 5326
  Gene Symbol: ELL
  Gene Name: elongation factor RNA polymerase II
  ENST ID: ENST00000596124
  CDS Start-End: 385-1851
aactcgccgtgtgtgtgtcagagaatgttgctcctgtgccctgagtcaacaaagacggcccctgtgagctcaagggcagttgggaaggtgtagcgaacatcctgtaaaacgtcccatcttgattctgtttcactgaggccatctatccgatttcaaggaagccaagggcacatctccatcccccagcctgactgccccgcagaggcgcggacgttctccttctacctctccaacatcggccgcgacaacccccagggcagcttcgactgcatccagcagtatgtctccagtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtggccaacatgagtgctaaggacggcacgtgtacactgcaggactgcatgtacaaggatgtgcagaaggactggcctggctactcggagggggaccagcagctgctgaagcgggtgctcgtccggaagctgtgccagccacagagcactggcagcctccttggagaccctgctgcctccagccccccaggcgagcgtgggcgctcggcctcgcccccacagaagcggctgcagcctcctgatttcatcgaccccctagccaacaagaaaccccggatatcgcacttcactcagagagctcagcctgccgtcaacgggaagctgggcgtgcccaatggccgtgaggccttgctgcccaccccgggcccaccagccagcacggacaccctcagctccagcactcacctgcccccgcggctggagcccccgagggcccacgaccccctggccgatgtcagcaatgacctgggccacagcggccgagactgtgagcacggagaggcggctgccccagcccccactgtgcgcctcggcctgcccctgctgacggactgtgcccagcccagcaggccacacggcagcccctcgcgcagcaagcccaagaagaagtccaagaagcacaaagacaaggagagggcggctgaggacaagccccgggcccagcttccagactgtgcacctgccacccatgccacccccggagccccagcagacaccccaggtttaaacggaacctgcagcgtttccagtgttcccacgtccacgtcggagacgcctgactacttgctgaagtacgcagccatctcctcttcggagcagcgccagagctacaagaacgacttcaatgccgagtacagcgagtaccgcgacctgcacgcccgcattgagcgcatcacgcggcggttcacccagctcgacgcccagctccggcagctctcccagggctccgaggagtatgagactactcgagggcagattttgcaggaatatcgaaaaatcaaaaagaccaacaccaactacagccaggagaagcaccgctgcgagtacctgcacagcaagctggcccacatcaagaggctcatcgccgagtacgaccagcggcagctgcaggcttggccctagc

SEQ ID NO: 129499 - DNA, 4074 bp, Homo sapiens
  Payload ID: 5326
  Gene Symbol: ELL
  Gene Name: elongation factor RNA polymerase II
  ENST ID: ENST00000594635
  CDS Start-End: 62-286
gcgtggccggcgtggcggcgctggagccgggaagggggcgcgggggagagatggtcgcaagatggcggcgctgaaggaggataggagctacgggctgtcgtgcgggcgggttagcgacggcagcaaggtgtcggtgttccacgtgaagctcaccgacagtgccctgagggccttcgagagctaccgcgccagacaggattctgtttcactgaggccatctatccgatttcaaggaagccaagggcctgagagctctgcacagctggatgtggggatatggacatgatgatccatgggcttccagcacatctccatcccccagcctgactgccccgcagaggcgcggacgttctccttctacctctccaacatcggccgcgacaacccccagggcagcttcgactgcatccagcagtatgtctccagtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtggccaacatgagtgctaaggacggcacgtgtacactgcaggactgcatgtacaaggatgtgcagaaggactggcctggctactcggagggggaccagcagctgctgaagcgggtgctcgtccggaagctgtgccagccacagagcactggcagcctccttggagaccctgctgcctccagccccccaggcgagcgtgggcgctcggcctcgcccccacagaagcggctgcagcctcctgatttcatcgaccccctagccaacaagaaaccccggatatcgcacttcactcagagagctcagcctgccgtcaacgggaagctgggcgtgcccaatggccgtgaggccttgctgcccaccccgggcccaccagccagcacggacaccctcagctccagcactcacctgcccccgcggctggagcccccgagggcccacgaccccctggccgatgtcagcaatgacctgggccacagcggccgagactgtgagcacggagaggcggctgccccagcccccactgtgcgcctcggcctgcccctgctgacggactgtgcccagcccagcaggccacacggcagcccctcgcgcagcaagcccaagaagaagtccaagaagcacaaagacaaggagagggcggctgaggacaagccccgggcccagcttccagactgtgcacctgccacccatgccacccccggagccccagcagacaccccaggtttaaacggaacctgcagcgtttccagtgttcccacgtccacgtcggagacgcctgactacttgctgaagtacgcagccatctcctcttcggagcagcgccagagctacaagaacgacttcaatgccgagtacagcgagtaccgcgacctgcacgcccgcattgagcgcatcacgcggcggttcacccagctcgacgcccagctccggcagctctcccagggctccgaggagtatgagactactcgagggcagattttgcaggaatatcgaaaaatcaaaaagaccaacaccaactacagccaggagaagcaccgctgcgagtacctgcacagcaagctggcccacatcaagaggctcatcgccgagtacgaccagcggcagctgcaggcttggccctagccgccctccccgatggcggggatctgggagggtcgggggagcaaaaggcggtgagagaggatttatttaaaaaaataaacccgaggaagatgctcatctgagccagcaccgccggctttcagggcagcccctgcagacgtctggccctggcgggtggctgcaagcccacctcggccctccctgcgcttcctgagcagtccctgcttatgatgggctccccaggaagcccactgcctcctccctggctgcagcctccggggttcagcctcctgtctcgccagaagactcctaggcccttggggtggcgcgcctgccttttctagttttatacaaagacagccacttttagctactgctaatgagacttgagtctatttttgtacaaaagagaagcaaaatcttttttctaaacctgtgcctccctctcctcggacacccagggtctagccgctgccctgggtcctgcctgcagtattacagaggtcgtcgaaaggtgcagctgcgttctgagggcgtggggaatgggcaggtggcctctgctggtctctggctctacgtttaggcacccctttccccagcctctcctccttgggcagggtctctgctccagcaagcaaacagggtggcccaggtggctattttgagaactccagctggtgcccccagacagctgctcagagccaagggggcagagggctttcagcgcccccaggcctgccctgctatttcaggccctcagctgtcgggggccactgtgtttctgtgctccaagttgagactcggccgcagcggcgtcagacttttctttgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccagggcatggtggggtctgaggcgtgtgttcccatttagggctgaatgaagccatgacttggaaaggtggtggggggtggatggcggctgtgactcagggcccagggatcacatgggggtcactgctgccatcagcagtcaggcagggagaacagaaatgcaaaaatacagatgtctatttttctaaactggggggtggaggggtgcctcctgacagcttccaaagagctgactgtggagggcccacagtgtatcccacccctgcccgagagtctctctcctttgggacccccgggttcccagagctccgaggaaactgatccttcatgtttcaatagctgttgttgtttttctctttgggccgggccgggccggggaagggccgagcaggctccaggaggcctccagagtcagctggaccttgctgtgtcgcccgcaggcagccctgcagacaccggtgaggtgggatgatttcaggaggtcccagcccgggactgcccgcccctctgccctgggaaccagtccaaggggctgtcagttgaatttgcctttttgttgttgttgttgtttttgttgtttatttgttctccttttaaggaattatgaagctaagaaaagttttgtgttttgggggttggtggacaaagttctagctgattaaatatggtctaacttattgatactatttttttttcttttaatgttgtactgtggagaaaaactattttgagccatggggttggtgtttacaagaactttccacttttgccaaaatgttacaattgaaaggcatctatctgcgtcttcagtttcctgatattttcttaaaagatctagtgtcctttttgtacactaaacaggtgaatgctgacttttttcattctccaataaatttcactgaactg

SEQ ID NO: 129500 - DNA, 2352 bp, Homo sapiens
  Payload ID: 5327
  Gene Symbol: ELL3
  Gene Name: elongation factor RNA polymerase II-like 3
  Uniprot ID: Q9HB65
  ENST ID: ENST00000319359
  CDS Start-End: 643-1836
aactttcactgctgccaccacaaccgcagggccccaattacctctctgttagaaatcggtttcagagcggtggaaccgcgggcgggaaaaagcccaggcgctgtctcgggtgccccttcgtgtcagccatcctctggtctctcgggtctccgaagctcggggctaactgggcgcgaaccgctgagcccgcctaccaaccaggccctttctcccgcccctctgcggctgaaaccctcaaggggttgcaggttcagctttcacttagagacagcaactccaaattcagggtcgctggggaaactaaggcaggactggggactctgagtgagaggtcagacgctggtcgcggactctttctcccgagaactggggatagctcttccgatagcccaaagcgattcatgcggatcctagaagaaagcgccgaggtccgggcggttggccggggagagcgaagcgccgcccacgcggctgggaaagcttggggtggcgctggcgggaggtggggccgggggcgggttcctggcggagggtggggcagacgtgggttaccgggtgtgccaaccaaaccctgaacagaggaggtggcggtggtggccctcgcctgtggcccccgtgctgcttgcactcgaactcgtcgccatggaggagctccaggagcctctgagaggacagctccggctctgcttcacgcaagctgcccggactagcctcttactgctcaggctcaacgacgctgccctgcgggcgctgcaagagtgtcagcggcaacaggtacggccggtgattgctttccaaggccaccgagggtatctgagactcccaggccctggttggtcctgcctcttctccttcatagtgtcccagtgttgtcaggagggcgctggtggtagcttggaccttgtgtgccaacgcttcctcaggtctgggcctaacagcctccactgcctgggctcactcagggagcgcctcattatttgggcagccatggattctatcccagccccatcatcagttcagggacacaacctgactgaagatgccagacatcctgagagttggcagaacacaggaggctattctgaaggagatgcagtatcacagccacagatggcactagaggaggtgtcagtgtcagatccactggcaagcaaccaaggacagtcactcccaggatcctcaagggagcacatggcacagtgggaagtgagaagccagacccatgttccaaacagagaacctgttcaggcactgccttcctctgccagccggaaacgtctggacaagaaacgttcagtgcctgtagccactgtagaactggaagaaaagaggttcagaactctgcctttagtgccaagccccctacaaggcctgaccaatcaggatttacaagagggagaagattgggagcaagaagatgaggacatggaccccagattagaacacagttcctcagttcaagaagattctgaatccccaagtcctgaagatataccagactacctcctgcaatacagggccatccacagtgcagaacagcaacatgcctatgagcaggactttgagacagattatgctgaataccgcatcctgcatgcccgtgttgggactgcaagccaaaggttcatagagctgggagcagagattaaaagagttcggcgaggaactccagaatacaaggtcctggaagacaagataatccaggaatataaaaagttcaggaagcagtacccaagttacagagaagaaaagcgtcgctgtgagtaccttcaccagaaattgtcccacattaaaggtctcatcctggagtttgaggaaaagaacaggggcagctgaagttatcaagggaatttttgagcctctgcttagtgaaacacaaaggaacaaagcagctataaactaaatagaatgcaactatctgcttttcttatgctgaccactggagtccatggtggcaagtagagagctgctctaggttcttgaggtttggttttcattattaatttttagggtatgggcactgtgcaaagactccatagctgtgcctaggagtctaggaaaagtgacagaggcttggcttttttacctttagttcagccaagtcattttcaagtcctgagaaatgacatcatcttcaggataaaataatgaggacattagacaaaccaaactaagtgaattttagcctggtagcctctctaaggaaacagtaataataacttctgataagagttaaaagaacttgtagcatacctggatataatgggaaagggcctgggtgttacccatgtactgaaaatgaacttttaccaacatggctaaaaaattaaaactgactgcttctgtgtcctt

SEQ ID NO: 129501 - DNA, 792 bp, Homo sapiens
  Payload ID: 5327
  Gene Symbol: ELL3
  Gene Name: elongation factor RNA polymerase II-like 3
  ENST ID: ENST00000433927
  CDS Start-End: 174-792
aaaccctcaaggggttgcaggttcagctttcacttagagacagcaactccaaattcagggtcgctggggaaactaaggcaggactggggactctgagtgagaggtcagacgctggtcgcggactctttctcccgagaactggggatagctcttccgatagcccaaagcgattcatgcggatcctagaagaaagcgccgagaggaggtggcggtggtggccctcgcctgtggcccccgtgctgcttgcactcgaactcgtcgccatggaggagctccaggagcctctgagaggacagctccggctctgcttcacgcaagctgcccggactagcctcttactgctcaggctcaacgacgctgccctgcgggcgctgcaagagtgtcagcggcaacaggtacggccggtgattgctttccaaggccaccgagggtatctgagactcccaggccctggttggtcctgcctcttctccttcatagtgtcccagtgttgtcaggagggcgctggtggtagcttggaccttgtgtgccaacgcttcctcaggtctgggcctaacagcctccactgcctgggctcactcagggagcgcctcattatttgggcagccatggattctatcccagccccatcatcagttcagggacacaacctgactgaagatgccagacatcctgagagttggcagaacacaggaggctattctgaaggagatgcagtatcacagccacagatggcactagaggaggtgtcagtgtcagatccactggcaagcaaccaaggacagtcactcc

SEQ ID NO: 129502 - DNA, 3675 bp, Homo sapiens
  Payload ID: 5328
  Gene Symbol: EFTUD1
  Gene Name: elongation factor Tu GTP binding domain containing 1
  Uniprot ID: Q7Z2Z2
  ENST ID: ENST00000268206
  CDS Start-End: 170-3532
agagacgtgcgggtgaaaggtcgagcgacagccggccccgccccctggcgcgcgggcgtgtcggacccgcagagctctcggactttcggaagctctcggtgtgggtgcgacccgagagaaggagcggggctggtggggctgctgcagccgtcacaggaaataagtaatcatggtgctcaacagtttggataagatgattcaactccagaaaaacactgccaacatcaggaatatttgtgttttggctcatgttgaccatggaaaaactactctggctgactgtcttatatctagcaatggaatcatctccagccgcctagcaggcaagttaaggtacatggacagcagagaagatgaacagatccgagggatcactatgaaatccagtgccatttccctacattatgcaacaggtaatgaggagtacctgatcaatctgatagactctccaggacacgtggacttttcctcagaagtatcaaccgctgttcgcatttgtgatggatgcatcattgtggtagatgctgtggaaggagtctgtccacagacacaggcagttctgcgacaagcttggcttgaaaacatccgtccggttttagtgattaataagattgatcgcttgatagtggaactgaaattcaccccacaagaggcctattctcacctcaagaatattttagaacagattaatgcgctcacagggactctttttacttctaaagtcctagaagaaagagcagagagggagactgaatcccaagtgaatccaaattctgaacaaggagagcaagtatatgactggagcactggcttggaggacacagatgattctcacctttacttctctccagaacagggaaatgtggtgtttaccagtgcaatagatgggtggggctttggaattgagcacttcgccagaatctacagtcaaaaaattggcatcaaaaaggaagttcttatgaaaaccttgtggggagattactatataaatatgaaggctaaaaagatcatgaagggtgatcaggccaaaggaaagaaacctttatttgtacagttgatcctggaaaatatatggagtttgtatgatgctgttttgaaaaaggacaaagacaaaattgataaaatagtgacttctttaggattaaaaattggagcccgggaggcacgacattcagaccctaaagttcagatcaacgccatttgcagtcagtggctacccatatcccatgctgttcttgctatggtgtgtcagaaacttcctagtccccttgatattacagctgagagagtggagagactgatgtgcacaggatcacaaacttttgactcttttccaccagaaactcaagcactgaaagcagcttttatgaaatgtggaagtgaggacactgctccagttattatatttgtttccaaaatgtttgcagttgatgctaaggccttgcctcagaataagccaaggcctctcactcaagaagaaattgctcagagacgtgagcgtgcaagacaaaggcatgcagagaagcttgcagcagcacagggacaggcacccttggagcccacccaagatgggagtgccattgaaacatgtccaaaaggagaggagccaagaggtgacgagcaacaggtggaaagtatgacccctaaacctgtgctccaggaagaaaacaaccaagagtcttttattgcatttgctcgggtgttcagtggtgtggctcgaagaggaaagaaaatttttgtcttggggcccaaatacagtcctcttgagtttttacgaagggtaccattaggcttctcagctccaccagatggcctcccccaagtcccccacatggcatactgtgctctggaaaacctgtatcttctgatgggaagggaactggaatatctagaggaggtacctccaggaaatgtgctaggaataggaggccttcaagattttgtgctgaaatctgcaacactgtgtagcctgccatcctgcccaccatttataccactcaacttcgaagccactcctattgtgagagttgctgttgaaccaaaacatccaagtgaaatgcctcagctcgtaaaaggaatgaaactgttaaaccaggctgatccctgtgtccagattttaattcaggaaacgggagagcacgttttagtcacagcaggagaagtccaccttcagcgatgcctggatgacttaaaagaaaggtttgcaaagattcatatcagtgtatctgaacctattattccattcagagaaacaatcacaaaacccccaaaagttgacatggtcaatgaagaaataggcaaacagcaaaaagttgcagtcatacaccaaatgaaagaagatcaaagcaaaatccctgaaggaatccaagttgactctgacgggctaatcaccataacaactcccaataaacttgccacgctcagtgttcgagccatgccccttccagaagaagtcacccagattctggaagaaaatagtgatttgattcgttctatggagcagttgacatcctctttgaatgagggtgaaaatactcacatgattcatcagaagacccaagagaaaatttgggaattcaaaggaaaactggagcaacacctaacagggagaagatggaggaacattgttgaccaaatctggtcatttggcccaagaaaatgtgggcccaacatactagtcaataaaagtgaagattttcagaactcagtatggacaggtccagctgacaaagcttcaaaagaagccagtagataccgagatttgggcaatagcattgtgagtggcttccaactagcaaccctctctggccccatgtgtgaggagcctctcatgggtgtctgttttgttctggaaaaatgggacctaagtaaatttgaggaacaaggagcaagtgatctggcaaaagagggacaggaggaaaatgaaacctgttctggtggaaatgaaaaccaagagctacaagatggctgctctgaggcctttgagaagaggacatcacagaaaggagaatctccactcactgactgctatggacctttctcaggacagctaattgccaccatgaaagaagcatgtcgctatgcactgcaagtgaaacctcagcgcctgatggcagctatgtacacatgtgacatcatggccactggtgatgttctcggtcgagtctatgctgtcttgtcaaagagagaaggtcgggtacttcaagaagaaatgaaagaagggacagacatgttcatcatcaaggctgtgctgcctgttgctgaaagctttggttttgctgatgaaatcaggaagaggacaagtggcctggccagcccacaactagtattcagccattgggagatcattcccagtgaccccttctgggtgccaactactgaggaggaatacttgcactttggggagaaggctgactctgagaaccaagcccggaagtacatgaacgcagtacgaaagcggaaggggctttatgtggaagaaaagattgtggagcatgcagaaaagcagaggacactcagcaaaaataagtagctacctactactggtggattcttttccttatagtgaatttaaaagtatcatcaagggtttaatattgggaaaatttctttttgccacattatctctgtttattcactttcaataaagttgatccatataaatattttaaagag

SEQ ID NO: 129503 - DNA, 3470 bp, Homo sapiens
  Payload ID: 5328
  Gene Symbol: EFTUD1
  Gene Name: elongation factor Tu GTP binding domain containing 1
  Uniprot ID: Q7Z2Z2
  ENST ID: ENST00000359445
  CDS Start-End: 121-3330
gcgcgggcgtgtcggacccgcagagctctcggactttcggaagctctcggtgtgggtgcgacccgagagaaggagcggggctggtggggctgctgcagccgtcacaggaaataagtaatcatggtgctcaacagtttggataagatgattcaactccagaaaaacactgccaacatcaggaatatttgtgttttggctcatgttgaccatggtaatgaggagtacctgatcaatctgatagactctccaggacacgtggacttttcctcagaagtatcaaccgctgttcgcatttgtgatggatgcatcattgtggtagatgctgtggaaggagtctgtccacagacacaggcagttctgcgacaagcttggcttgaaaacatccgtccggttttagtgattaataagattgatcgcttgatagtggaactgaaattcaccccacaagaggcctattctcacctcaagaatattttagaacagattaatgcgctcacagggactctttttacttctaaagtcctagaagaaagagcagagagggagactgaatcccaagtgaatccaaattctgaacaaggagagcaagtatatgactggagcactggcttggaggacacagatgattctcacctttacttctctccagaacagggaaatgtggtgtttaccagtgcaatagatgggtggggctttggaattgagcacttcgccagaatctacagtcaaaaaattggcatcaaaaaggaagttcttatgaaaaccttgtggggagattactatataaatatgaaggctaaaaagatcatgaagggtgatcaggccaaaggaaagaaacctttatttgtacagttgatcctggaaaatatatggagtttgtatgatgctgttttgaaaaaggacaaagacaaaattgataaaatagtgacttctttaggattaaaaattggagcccgggaggcacgacattcagaccctaaagttcagatcaacgccatttgcagtcagtggctacccatatcccatgctgttcttgctatggtgtgtcagaaacttcctagtccccttgatattacagctgagagagtggagagactgatgtgcacaggatcacaaacttttgactcttttccaccagaaactcaagcactgaaagcagcttttatgaaatgtggaagtgaggacactgctccagttattatatttgtttccaaaatgtttgcagttgatgctaaggccttgcctcagaataagccaaggcctctcactcaagaagaaattgctcagagacgtgagcgtgcaagacaaaggcatgcagagaagcttgcagcagcacagggacaggcacccttggagcccacccaagatgggagtgccattgaaacatgtccaaaaggagaggagccaagaggtgacgagcaacaggtggaaagtatgacccctaaacctgtgctccaggaagaaaacaaccaagagtcttttattgcatttgctcgggtgttcagtggtgtggctcgaagaggaaagaaaatttttgtcttggggcccaaatacagtcctcttgagtttttacgaagggtaccattaggcttctcagctccaccagatggcctcccccaagtcccccacatggcatactgtgctctggaaaacctgtatcttctgatgggaagggaactggaatatctagaggaggtacctccaggaaatgtgctaggaataggaggccttcaagattttgtgctgaaatctgcaacactgtgtagcctgccatcctgcccaccatttataccactcaacttcgaagccactcctattgtgagagttgctgttgaaccaaaacatccaagtgaaatgcctcagctcgtaaaaggaatgaaactgttaaaccaggctgatccctgtgtccagattttaattcaggaaacgggagagcacgttttagtcacagcaggagaagtccaccttcagcgatgcctggatgacttaaaagaaaggtttgcaaagattcatatcagtgtatctgaacctattattccattcagagaaacaatcacaaaacccccaaaagttgacatggtcaatgaagaaataggcaaacagcaaaaagttgcagtcatacaccaaatgaaagaagatcaaagcaaaatccctgaaggaatccaagttgactctgacgggctaatcaccataacaactcccaataaacttgccacgctcagtgttcgagccatgccccttccagaagaagtcacccagattctggaagaaaatagtgatttgattcgttctatggagcagttgacatcctctttgaatgagggtgaaaatactcacatgattcatcagaagacccaagagaaaatttgggaattcaaaggaaaactggagcaacacctaacagggagaagatggaggaacattgttgaccaaatctggtcatttggcccaagaaaatgtgggcccaacatactagtcaataaaagtgaagattttcagaactcagtatggacaggtccagctgacaaagcttcaaaagaagccagtagataccgagatttgggcaatagcattgtgagtggcttccaactagcaaccctctctggccccatgtgtgaggagcctctcatgggtgtctgttttgttctggaaaaatgggacctaagtaaatttgaggaacaaggagcaagtgatctggcaaaagagggacaggaggaaaatgaaacctgttctggtggaaatgaaaaccaagagctacaagatggctgctctgaggcctttgagaagaggacatcacagaaaggagaatctccactcactgactgctatggacctttctcaggacagctaattgccaccatgaaagaagcatgtcgctatgcactgcaagtgaaacctcagcgcctgatggcagctatgtacacatgtgacatcatggccactggtgatgttctcggtcgagtctatgctgtcttgtcaaagagagaaggtcgggtacttcaagaagaaatgaaagaagggacagacatgttcatcatcaaggctgtgctgcctgttgctgaaagctttggttttgctgatgaaatcaggaagaggacaagtggcctggccagcccacaactagtattcagccattgggagatcattcccagtgaccccttctgggtgccaactactgaggaggaatacttgcactttggggagaaggctgactctgagaaccaagcccggaagtacatgaacgcagtacgaaagcggaaggggctttatgtggaagaaaagattgtggagcatgcagaaaagcagaggacactcagcaaaaataagtagctacctactactggtggattcttttccttatagtgaatttaaaagtatcatcaagggtttaatattgggaaaatttctttttgccacattatctctgtttattcactttcaataaagttgatccatataaatattttaaa

SEQ ID NO: 129504 - DNA, 639 bp, Homo sapiens
  Payload ID: 5328
  Gene Symbol: EFTUD1
  Gene Name: elongation factor Tu GTP binding domain containing 1
  ENST ID: ENST00000561389
  CDS Start-End: 141-317
agccggccccgccccctggcgcgcgggcgtgtcggacccgcagagctctcggactttcggaagctctcggtgtgggtgcgacccgagagaaggagcggggctggtggggctgctgcagccgtcacaggaaataagtaatcatggtgctcaacagtttggataagatgattcaactccagaaaaacactgccaacatcaggaatatttgtgttttggctcatgttgaccatggaaaaactactctggctgactgtcttatatctagcaatggaatcatctccagccgcctagcaggcaaggtaatgaggagtacctgatcaatctgatagactctccaggacacgtggacttttcctcagaagtatcaaccgctgttcgcatttgtgatggatgcatcattgtggtagatgctgtggaaggagtctgtccacagacacaggcagttctgcgacaagcttggcttgaaaacatccgtccggttttagtgattaataagattgatcgcttgatagtggaactgaaattcaccccacaagaggcctattctcacctcaagaatattttagaacagattaatgcgctcacagggactctttttacttctaaagtcctagaagaaagagcagagagggagactga

SEQ ID NO: 129505 - DNA, 417 bp, Homo sapiens
  Payload ID: 5328
  Gene Symbol: EFTUD1
  Gene Name: elongation factor Tu GTP binding domain containing 1
  ENST ID: ENST00000557939
  CDS Start-End: 1-417
gcagagaagatgaacagatccgagggatcactatgaaatccagtgccatttccctacattatgcaacaggtaatgaggagtacctgatcaatctgatagactctccaggacacgtggacttttcctcagaagtatcaaccgctgttcgcatttgtgatggatgcatcattgtggtagatgctgtggaaggagtctgtccacagattaatgcgctcacagggactctttttacttctaaagtcctagaagaaagagcagagagggagactgaatcccaagtgaatccaaattctgaacaaggagagcaagtatatgactggagcactggcttggaggacacagatgattctcacctttacttctctccagaacagggaaatgtggtgtttaccagtgcaatagatgggtggggctttg

SEQ ID NO: 129506 - DNA, 542 bp, Homo sapiens
  Payload ID: 5328
  Gene Symbol: EFTUD1
  Gene Name: elongation factor Tu GTP binding domain containing 1
  ENST ID: ENST00000558974
  CDS Start-End: 493-542
gtctggggccggggcggtcgcctgtctgtgtggacccaggatcctcaaagagaacgaatctgggaccctgcagaaatgaagggcatgtagtgtagaggtttttcctttttatttagaaaggaatgaaagaccggcagtgcacctgcttggataataagcacgtgacccaaaactttgttcgggctccatgggcaggaataaagctgggtatttgacctcgcgcgaggacgagcgagaatgtcagaatgagggacttgggggaagactgaagagagaaagggagcatcttcttcagcattttctctccctcctggatgcaacccttcctgtacgtggtcattggcctggagatgtttactggagtactcctccaccggcagggttactggtgtcactgtgcacccagtcccctcgagctgcgtgattcatcgcagcctttggatccggaaggatgagcaaactccttaagtgtaatcgtggaaataagtaatcatggtgctcaacagtttggataagatgattcaactccagaaaaacactgc

SEQ ID NO: 129507 - DNA, 521 bp, Homo sapiens
  Payload ID: 5328
  Gene Symbol: EFTUD1
  Gene Name: elongation factor Tu GTP binding domain containing 1
  ENST ID: ENST00000557844
  CDS Start-End: 431-521
gggtgcgacccgagagaaggagcggggctggtggggctgctgcagccgaaaggaatgaaagaccggcagtgcacctgcttggataataagcacgtgacccaaaactttgttcgggctccatgggcaggaataaagctgggtatttgacctcgcgcgaggacgagcgagaatgtcagaatgagggacttgggggaagactgaagagagaaagggagcatcttcttcagcattttctctccctcctggatgcaacccttcctgtacgtggtcattggcctggagatgtttactggagtactcctccaccggcagggttactggtgtcactgtgcacccagtcccctcgagctgcgtgattcatcgcagcctttggatccggaaggatgagcaaactccttaagtgtaatcgtgtcacaggaaataagtaatcatggtgctcaacagtttggataagatgattcaactccagaaaaacactgccaacatcaggaatatttgtgttttggctcatgttgaccatg

SEQ ID NO: 129508 - DNA, 3045 bp, Homo sapiens
  Payload ID: 5329
  Gene Symbol: EFTUD2
  Gene Name: elongation factor Tu GTP binding domain containing 2
  Uniprot ID: Q15029
  ENST ID: ENST00000402521
  CDS Start-End: 78-2891
gcaggcgtttcctcggcgtggggcggaagcacgatctccggcagcggcctgggaactcttagctgagcaggcgagagatggatgatgatgacgacgacgatgacgtaggagatcatgacgatgaccaccctgggatggaggtggtgctgcatgaggacaagaagtactacccaacagccgaggaggtgtatggtcctgaggtggagaccatagttcaagaggaagacactcagcctctcacagaacccattattaagccagtgaaaaccaagaaattcactctgatggagcagacattacctgttacggtgtatgagatggatttcttggcggatctgatggataactcagagctcatcagaaatgtgaccctttgtggacatctccaccatggcaagacatgttttgtggattgtttaattgaacagactcacccggaaatcagaaagcgctatgaccaagatctgtgctatactgacatcctcttcacagagcaagagagaggtgtaggcatcaaaagcactcctgtgacagtggtcttgccagacaccaaaggaaaatcttatctcttcaatatcatggacactccaggacatgtgaatttctctgatgaggtcacagctggcttgcgcatctcagatggagtggtccttttcattgatgctgctgagggggtgatgctgaacacagagcggctgatcaagcatgcggtgcaggagaggctggcagtcactgtgtgcatcaacaagattgaccggctgatcctggagctgaagctgcctccaactgatgcttattacaagctgcgccacattgtggatgaggtcaatggattaataagcatgtattccactgatgagaacctgatcctttccccactcctgggtaacgtctgcttctccagctcccagtacagcatctgcttcacgctgggctcctttgccaagatctatgccgacacctttggtgacattaattaccaagaatttgctaaaagactctggggtgacatctacttcaaccctaagacgcgaaagttcaccaaaaaggccccaactagcagctcccagagaagtttcgtggagtttatcttggagcctctttataagatcctcgcccaggttgtaggtgacgtggacaccagcctcccacggaccctagacgagcttggcatccacctgacgaaggaggagctgaagctgaacatccgccccttgctcaggctggtctgcaaaaagttctttggcgagttcacaggctttgtggacatgtgtgtgcagcatatcccttctccaaaggtgggcgccaagcccaagattgagcacacctacaccggtggtgtggactccgacctcggcgaggctatgagtgactgtgaccctgatggccccctgatgtgccacactactaagatgtacagcacagatgatggagtccagtttcacgcctttggccgggtgctgagtggcaccattcatgctgggcagcctgtgaaggtactgggggagaactacaccctggaggatgaggaagactcccagatatgcaccgtgggccgcctttggatctctgtggccaggtaccacatcgaggtgaaccgtgttcctgctggcaactgggttctgattgaaggtgttgatcaaccaattgtgaagacagcaaccataaccgaaccccgaggcaatgaggaggctcagattttccgacccttgaagttcaataccacatctgttatcaagattgctgtggagccagtcaacccctcagagctgcccaagatgcttgatggcctgcgcaaggtcaacaagagctatccatccctcaccaccaaggtggaggagtctggcgagcatgtgatcctgggcactggggagctctacctggactgtgtgatgcatgatttgcggaagatgtactcagagatagacatcaaggtggctgacccagttgtcacgttttgtgagacggtggtggaaacatcctccctcaagtgctttgctgaaacgcctaataagaagaacaagatcaccatgattgctgagcctcttgagaagggcctggcagaggacatagagaatgaggtggtccagattacgtggaacaggaagaagctgggagagttcttccagaccaagtacgattgggatctgctggctgcccgttccatctgggcttttggccctgatgcgactggccccaacattctggtggatgatactctgccctctgaggtggacaaggctcttcttggttcagtgaaggacagcatcgttcaaggtttccagtggggaaccagggagggccccctctgtgatgaattgattcggaatgtcaagtttaagatcctggatgcggtggttgcccaggagcccctgcaccggggcgggggccagatcatccccacagccaggagagtcgtctactctgccttcctcatggctactcctcgtctgatggagccttactactttgtagaggtccaggcccctgcagattgcgtctctgcagtttataccgtcctggccaggcgcagggggcacgtgactcaggatgcacccatcccaggctcccctctgtacaccatcaaagcttttatcccggccatcgactcttttggctttgagactgatctccggactcacacccagggacaagccttttctctgtctgtcttccaccactggcagattgtgcctggtgatcccctggacaagagcattgtcatccgccccttggagccacagccagctcctcacctggcccgggaattcatgatcaaaacccgccgtaggaagggcctcagtgaagatgtgagcatcagcaaattcttcgatgatcctatgttgctggaacttgccaaacaggatgttgtgctcaattaccccatgtgagtgcgtggactcctgggagctcctgctccctacagtgggctgcaactcctgtacttgaagctgagacctcatatgacgtggccttcgtgttgtcagagagtgtctggaagctgctgttgccatcttgaacaactcaccaacctccaacccagag

SEQ ID NO: 129509 - DNA, 4548 bp, Homo sapiens
  Payload ID: 5329
  Gene Symbol: EFTUD2
  Gene Name: elongation factor Tu GTP binding domain containing 2
  Uniprot ID: Q15029
  ENST ID: ENST00000426333
  CDS Start-End: 299-3217
ttcagggtggtcccgaggcgcctgatcagattcgttcatcctcagctctcaccctctttggagcagcccacgtcttgggctactcgtcttggggacccgctactccgccttgccagtccgcggcgggcatacctcggaactggtcctcaggcagagggttgtcctcccgggcagaaaggcgacagcggcgtctgcggggtccttcctggcggcgggcgcaggcgtttcctcggcgtggggcggaagcacgatctccggcagcggcctgggaactcttagctgagcaggcgagagcatcatggataccgacttatatgatgagtttgggaattatattggaccagagcttgattctgatgaagatgatgatgaattgggtagagagaccaaagatcttgatgagatggatgatgatgacgacgacgatgacgtaggagatcatgacgatgaccaccctgggatggaggtggtgctgcatgaggacaagaagtactacccaacagccgaggaggtgtatggtcctgaggtggagaccatagttcaagaggaagacactcagcctctcacagaacccattattaagccagtgaaaaccaagaaattcactctgatggagcagacattacctgttacggtgtatgagatggatttcttggcggatctgatggataactcagagctcatcagaaatgtgaccctttgtggacatctccaccatggcaagacatgttttgtggattgtttaattgaacagactcacccggaaatcagaaagcgctatgaccaagatctgtgctatactgacatcctcttcacagagcaagagagaggtgtaggcatcaaaagcactcctgtgacagtggtcttgccagacaccaaaggaaaatcttatctcttcaatatcatggacactccaggacatgtgaatttctctgatgaggtcacagctggcttgcgcatctcagatggagtggtccttttcattgatgctgctgagggggtgatgctgaacacagagcggctgatcaagcatgcggtgcaggagaggctggcagtcactgtgtgcatcaacaagattgaccggctgatcctggagctgaagctgcctccaactgatgcttattacaagctgcgccacattgtggatgaggtcaatggattaataagcatgtattccactgatgagaacctgatcctttccccactcctgggtaacgtctgcttctccagctcccagtacagcatctgcttcacgctgggctcctttgccaagatctatgccgacacctttggtgacattaattaccaagaatttgctaaaagactctggggtgacatctacttcaaccctaagacgcgaaagttcaccaaaaaggccccaactagcagctcccagagaagtttcgtggagtttatcttggagcctctttataagatcctcgcccaggttgtaggtgacgtggacaccagcctcccacggaccctagacgagcttggcatccacctgacgaaggaggagctgaagctgaacatccgccccttgctcaggctggtctgcaaaaagttctttggcgagttcacaggctttgtggacatgtgtgtgcagcatatcccttctccaaaggtgggcgccaagcccaagattgagcacacctacaccggtggtgtggactccgacctcggcgaggctatgagtgactgtgaccctgatggccccctgatgtgccacactactaagatgtacagcacagatgatggagtccagtttcacgcctttggccgggtgctgagtggcaccattcatgctgggcagcctgtgaaggtactgggggagaactacaccctggaggatgaggaagactcccagatatgcaccgtgggccgcctttggatctctgtggccaggtaccacatcgaggtgaaccgtgttcctgctggcaactgggttctgattgaaggtgttgatcaaccaattgtgaagacagcaaccataaccgaaccccgaggcaatgaggaggctcagattttccgacccttgaagttcaataccacatctgttatcaagattgctgtggagccagtcaacccctcagagctgcccaagatgcttgatggcctgcgcaaggtcaacaagagctatccatccctcaccaccaaggtggaggagtctggcgagcatgtgatcctgggcactggggagctctacctggactgtgtgatgcatgatttgcggaagatgtactcagagatagacatcaaggtggctgacccagttgtcacgttttgtgagacggtggtggaaacatcctccctcaagtgctttgctgaaacgcctaataagaagaacaagatcaccatgattgctgagcctcttgagaagggcctggcagaggacatagagaatgaggtggtccagattacgtggaacaggaagaagctgggagagttcttccagaccaagtacgattgggatctgctggctgcccgttccatctgggcttttggccctgatgcgactggccccaacattctggtggatgatactctgccctctgaggtggacaaggctcttcttggttcagtgaaggacagcatcgttcaaggtttccagtggggaaccagggagggccccctctgtgatgaattgattcggaatgtcaagtttaagatcctggatgcggtggttgcccaggagcccctgcaccggggcgggggccagatcatccccacagccaggagagtcgtctactctgccttcctcatggctactcctcgtctgatggagccttactactttgtagaggtccaggcccctgcagattgcgtctctgcagtttataccgtcctggccaggcgcagggggcacgtgactcaggatgcacccatcccaggctcccctctgtacaccatcaaagcttttatcccggccatcgactcttttggctttgagactgatctccggactcacacccagggacaagccttttctctgtctgtcttccaccactggcagattgtgcctggtgatcccctggacaagagcattgtcatccgccccttggagccacagccagctcctcacctggcccgggaattcatgatcaaaacccgccgtaggaagggcctcagtgaagatgtgagcatcagcaaattcttcgatgatcctatgttgctggaacttgccaaacaggatgttgtgctcaattaccccatgtgagtgcgtggactcctgggagctcctgctccctacagtgggctgcaactcctgtacttgaagctgagacctcatatgacgtggccttcgtgttgtcagagagtgtctggaagctgctgttgccatcttgaacaactcaccaacctccaacccagagccccagtgagagaggagcatttggcctcctgcttccttctgtggcctctgccgggctccattcccaaggaaaagagaggagcttgggctcacagaaagagaaggggatgaaaccccaaggggccctatctttgggatttacatggaattttattttctacaagtttgaccttagccatggtttgcaagtgaacagaacattctgacctctgtcttgctctgctcctttcatcctcgtctcccctgccccgtctggtgcttacattctgaatatatgtcatctcccaagaggcttcactgcctctgcttccagctgcagcctccttcctgcctgggtccccagggaagccgcctgccttttaattcagtgttcccatgagcgccaaggccccattattgcccccttgctcccactccatgctgcttctgggtggaacctaagatggcttgggagttgttgggttcctgcgatcagaagtctaccccaccacctcctcaggaaactgctgcctcccctaagaatcttccttgccctggagtagggggccagagcactttgatttccagccatttactccaagtcctctccccagctaccaccagtcccttactctgttctcccccagtgaaaaagagtctgttgattttcctcaaaactgctttattaggaatgtaccagggattgagttaggggagttggacagccccggctcctataggagtcctacttctctccagcatcctgtgccatcctcttgacgtaatcgctgtacattgtgtacacagcacctgtgtgagagaaaagaaataatgccccttggcatcaaacccttcacccgtcctctggctctcaggcgtcctaggggttcacctctagctgctcccttgagagtccagcttcccgctcatctttctgccccaggtcccaacagctgcttcaagcatctgaccacacaacctggggaaaccacttatctgacagttcacgaaacactttcacatgtattgtgtatctgagaaacctcacagcagcctgcaaggtaggcaggccaggggtggttattgtcatgttacacatcaggaaactgaggctcagtgagaaagatttgtccactgtcacacagttagcaagtggctgtctgctttttaatctcaagaggaagagaaattcaacatct

SEQ ID NO: 129510 - DNA, 551 bp, Homo sapiens
  Payload ID: 5329
  Gene Symbol: EFTUD2
  Gene Name: elongation factor Tu GTP binding domain containing 2
  ENST ID: ENST00000593072
  CDS Start-End: 107-551
agcggcctgggaactcttagctgagcaggcgagagccgttctttgccaagttccctccgaagtcctctgagctcctgcattgtagcgggaagcggcagtgagcatcatggataccgacttatatgatgagtttgggaattatattggaccagagcttgattctgatgaagatgatgatgaattgggtagagagaccaaagatcttgatgagatggatgatgatgacgacgacgatgacgtaggagatcatgacgatgaccaccctgggatggaggtggtgctgcatgaggacaagaagtactacccaacagccgaggaggtgtatggtcctgaggtggagaccatagttcaagaggaagacactcagcctctcacagaacccattattaagccagtgaaaaccaagaaattcactctgatggagcagacattacctgttacggtgtatgagatggatttcttggcggatctgatggataactcagagctcatcagaaatgtgaccctttgtggacatctccaccatggcaagacatgttttgtggattgtt

SEQ ID NO: 129511 - DNA, 562 bp, Homo sapiens
  Payload ID: 5329
  Gene Symbol: EFTUD2
  Gene Name: elongation factor Tu GTP binding domain containing 2
  ENST ID: ENST00000592701
  CDS Start-End: 244-562
gctttcagccgttctttgccaagttccctccgaagtcctctgagctcctgcattgtagcgggaagcggcagtgaggtaacatcagacaacctcaaatcaagggacatccttaaggatttcatgacagtccttggaaggaaagactgaagattgtagatccaaagactgaagattgtagatccaaagagactagagacatgacaaccaaatgcaaacatgatcctggattggatccttagcatcatggataccgacttatatgatgagtttgggaattatattggaccagagcttgattctgatgaagatgatgatgaattgggtagagagaccaaagatcttgatgagatggatgatgatgacgacgacgatgacgtaggagatcatgacgatgaccaccctgggatggaggtggtgctgcatgaggacaagaagtactacccaacagccgaggaggtgtatggtcctgaggtggagaccatagttcaagaggaagacactcagcctctcacagaacccattattaagccagtgaaaaccaagaaattcactctgatggagc

SEQ ID NO: 129512 - DNA, 689 bp, Homo sapiens
  Payload ID: 5329
  Gene Symbol: EFTUD2
  Gene Name: elongation factor Tu GTP binding domain containing 2
  ENST ID: ENST00000589769
  CDS Start-End: 1-404
tccagaccaagtacgattgggatctgctggctgcccgttccatctgggcttttggccctgatgcgactggccccaacattctggtggatgatactctgccctctgaggtggacaaggctcttcttggttcagtgaaggacagcatcgttcaaggtttccagtggggaaccagggagggccccctctgtgatgaattgattcggaatgtcaagtttaagatcctggatgcggtggttgcccaggagcccctgcaccggggcgggggccagatcatccccacagccaggagagtcgtctactctgccttcctcatgggggcacgtgactcaggatgcacccatcccaggctcccctctgtacaccatcaaagcttttatcccggccatcgactcttttggctttgagactgatctccggactcacacccagggacaagccttttctctgtctgtcttccaccactggcagattgtgcctggtgatcccctggacaagagcattgtcatccgccccttggagccacagccagctcctcacctggcccgggaattcatgatcaaaacccgccgtaggaagggcctcagtgaagatgtgagcatcagcaaattcttcgatgatcctatgttgctggaacttgccaaacaggatgttgtgctcaattaccccatgtgagtgcgtggactcctggg

SEQ ID NO: 129513 - DNA, 3364 bp, Homo sapiens
  Payload ID: 5329
  Gene Symbol: EFTUD2
  Gene Name: elongation factor Tu GTP binding domain containing 2
  Uniprot ID: Q15029
  ENST ID: ENST00000592576
  CDS Start-End: 68-2956
ggcgtggggcggaagcacgatctccggcagcggcctgggaactcttagctgagcaggcgagagcatcatggataccgacttatatgatgagtttgggaattatattggaccagagcttgattctgatgaagatgatgatgaattgggtagagagaccaaagatcttgatgagatggatgatgatgacgacgacgatgacgtaggagatcatgacgatgaccaccctgggatggaggtggtgctgcatgaggacaagaagtactacccaacagccgaggaggtgtatggtcctgaggtggagaccatagttcaagaggaagacactcagcctctcacagaacccattattaagccagtgaaaaccaagaaattcactctgatggagcagacattacctgttacggtgtatgagatggatttcttggcggatctgatggataactcagagctcatcagaaatgtgaccctttgtggacatctccaccatggcaagactcacccggaaatcagaaagcgctatgaccaagatctgtgctatactgacatcctcttcacagagcaagagagaggtgtaggcatcaaaagcactcctgtgacagtggtcttgccagacaccaaaggaaaatcttatctcttcaatatcatggacactccaggacatgtgaatttctctgatgaggtcacagctggcttgcgcatctcagatggagtggtccttttcattgatgctgctgagggggtgatgctgaacacagagcggctgatcaagcatgcggtgcaggagaggctggcagtcactgtgtgcatcaacaagattgaccggctgatcctggagctgaagctgcctccaactgatgcttattacaagctgcgccacattgtggatgaggtcaatggattaataagcatgtattccactgatgagaacctgatcctttccccactcctgggtaacgtctgcttctccagctcccagtacagcatctgcttcacgctgggctcctttgccaagatctatgccgacacctttggtgacattaattaccaagaatttgctaaaagactctggggtgacatctacttcaaccctaagacgcgaaagttcaccaaaaaggccccaactagcagctcccagagaagtttcgtggagtttatcttggagcctctttataagatcctcgcccaggttgtaggtgacgtggacaccagcctcccacggaccctagacgagcttggcatccacctgacgaaggaggagctgaagctgaacatccgccccttgctcaggctggtctgcaaaaagttctttggcgagttcacaggctttgtggacatgtgtgtgcagcatatcccttctccaaaggtgggcgccaagcccaagattgagcacacctacaccggtggtgtggactccgacctcggcgaggctatgagtgactgtgaccctgatggccccctgatgtgccacactactaagatgtacagcacagatgatggagtccagtttcacgcctttggccgggtgctgagtggcaccattcatgctgggcagcctgtgaaggtactgggggagaactacaccctggaggatgaggaagactcccagatatgcaccgtgggccgcctttggatctctgtggccaggtaccacatcgaggtgaaccgtgttcctgctggcaactgggttctgattgaaggtgttgatcaaccaattgtgaagacagcaaccataaccgaaccccgaggcaatgaggaggctcagattttccgacccttgaagttcaataccacatctgttatcaagattgctgtggagccagtcaacccctcagagctgcccaagatgcttgatggcctgcgcaaggtcaacaagagctatccatccctcaccaccaaggtggaggagtctggcgagcatgtgatcctgggcactggggagctctacctggactgtgtgatgcatgatttgcggaagatgtactcagagatagacatcaaggtggctgacccagttgtcacgttttgtgagacggtggtggaaacatcctccctcaagtgctttgctgaaacgcctaataagaagaacaagatcaccatgattgctgagcctcttgagaagggcctggcagaggacatagagaatgaggtggtccagattacgtggaacaggaagaagctgggagagttcttccagaccaagtacgattgggatctgctggctgcccgttccatctgggcttttggccctgatgcgactggccccaacattctggtggatgatactctgccctctgaggtggacaaggctcttcttggttcagtgaaggacagcatcgttcaaggtttccagtggggaaccagggagggccccctctgtgatgaattgattcggaatgtcaagtttaagatcctggatgcggtggttgcccaggagcccctgcaccggggcgggggccagatcatccccacagccaggagagtcgtctactctgccttcctcatggctactcctcgtctgatggagccttactactttgtagaggtccaggcccctgcagattgcgtctctgcagtttataccgtcctggccaggcgcagggggcacgtgactcaggatgcacccatcccaggctcccctctgtacaccatcaaagcttttatcccggccatcgactcttttggctttgagactgatctccggactcacacccagggacaagccttttctctgtctgtcttccaccactggcagattgtgcctggtgatcccctggacaagagcattgtcatccgccccttggagccacagccagctcctcacctggcccgggaattcatgatcaaaacccgccgtaggaagggcctcagtgaagatgtgagcatcagcaaattcttcgatgatcctatgttgctggaacttgccaaacaggatgttgtgctcaattaccccatgtgagtgcgtggactcctgggagctcctgctccctacagtgggctgcaactcctgtacttgaagctgagacctcatatgacgtggccttcgtgttgtcagagagtgtctggaagctgctgttgccatcttgaacaactcaccaacctccaacccagagccccagtgagagaggagcatttggcctcctgcttccttctgtggcctctgccgggctccattcccaaggaaaagagaggagcttgggctcacagaaagagaaggggatgaaaccccaaggggccctatctttgggatttacatggaattttattttctacaagtttgaccttagccatggtttgcaagtgaacagaacattctgacctctgtcttgctctgctcctttcatcctcgtctcccctgccccgtctg

SEQ ID NO: 129514 - DNA, 899 bp, Homo sapiens
  Payload ID: 5329
  Gene Symbol: EFTUD2
  Gene Name: elongation factor Tu GTP binding domain containing 2
  ENST ID: ENST00000590124
  CDS Start-End: 1-672
gtggaaacatcctccctcaagtgctttgctgaaacgcctaataagaagaacaagatcaccatgattgctgagcctcttgagaagggcctggcagaggacatagagaatgaggtggtccagattacgtggaacaggaagaagctgggagagttcttccagaccaagtacgattgggatctgctggctgcccgttccatctgggcttttggccctgatgcgactggccccaacattctggtggatgatactctgccctctgaggtggacaaggctcttcttggttcagtgaaggacagcatcgttcaaggtttccagtggggaaccagggagggccccctctgtgatgaattgattcggaatgtcaagtttaagatcctggatgcggtggttgcccaggagcccctgcaccggggcgggggccagatcatccccacagccaggagagtcgtctactctgccttcctcatgattgtgcctggtgatcccctggacaagagcattgtcatccgccccttggagccacagccagctcctcacctggcccgggaattcatgatcaaaacccgccgtaggaagggcctcagtgaagatgtgagcatcagcaaattcttcgatgatcctatgttgctggaacttgccaaacaggatgttgtgctcaattaccccatgtgagtgcgtggactcctgggagctcctgctccctacagtgggctgcaactcctgtacttgaagctgagacctcatatgacgtggccttcgtgttgtcagagagtgtctggaagctgctgttgccatcttgaacaactcaccaacctccaacccagagccccagtgagagaggagcatttggcctcctgcttccttctgtggcctctgccgggctccattcccaaggaaaa

SEQ ID NO: 129515 - DNA, 524 bp, Homo sapiens
  Payload ID: 5329
  Gene Symbol: EFTUD2
  Gene Name: elongation factor Tu GTP binding domain containing 2
  ENST ID: ENST00000588374
  CDS Start-End: 1-102
tttgggaattatattggaccagagcttgattctgatgaagatgatgatgaattgggtagagagaccaaagatcttgatgagaacccattattaagccagtgaaaaccaagaaattcactctgatggagcagacattacctgttacggtgtatgagatggatttcttggcggatctgatggataactcagagctcatcagaaatgtgaccctttgtggacatctccaccatggcaagacatgttttgtggattgtttaattgaacagactcacccggaaatcagaaagcgctatgaccaagatctgtgctatactgacatcctcttcacagagcaagagagaggtgtaggcatcaaaagcactcctgtgacagtggtcttgccagacaccaaaggaaaatcttatctcttcaatatcatggacactccaggacatgtgaatttctctgatgaggtcacagctggcttgcgcatctcagatggagtggtccttttcattgatgctgctgagggggtgatgctgaac

SEQ ID NO: 129516 - DNA, 3675 bp, Homo sapiens
  Payload ID: 5329
  Gene Symbol: EFTUD2
  Gene Name: elongation factor Tu GTP binding domain containing 2
  Uniprot ID: Q15029
  ENST ID: ENST00000591382
  CDS Start-End: 399-3317
gtaagttgaagcgggtcagcggcacggaagggttgctccaggtgggataggaaattaaaaagcgtcagatctggaaggggccttatatgctattggcccctttcgctttacggatcggtaaattgaggcctggagcgggaaaaagaatggaagaccctgtcgtcctcgtgccttcccaaggcttccgaagcgcgcacacacgcacacacctcgatttcggggctgcctctatagcctcagtccgtaaaatcgtatcgctaggtaggagtggtgctctaactgtccagtcccctcgctcacttcctcttctatccgtgccgctttcagccgttctttgccaagttccctccgaagtcctctgagctcctgcattgtagcgggaagcggcagtgagcatcatggataccgacttatatgatgagtttgggaattatattggaccagagcttgattctgatgaagatgatgatgaattgggtagagagaccaaagatcttgatgagatggatgatgatgacgacgacgatgacgtaggagatcatgacgatgaccaccctgggatggaggtggtgctgcatgaggacaagaagtactacccaacagccgaggaggtgtatggtcctgaggtggagaccatagttcaagaggaagacactcagcctctcacagaacccattattaagccagtgaaaaccaagaaattcactctgatggagcagacattacctgttacggtgtatgagatggatttcttggcggatctgatggataactcagagctcatcagaaatgtgaccctttgtggacatctccaccatggcaagacatgttttgtggattgtttaattgaacagactcacccggaaatcagaaagcgctatgaccaagatctgtgctatactgacatcctcttcacagagcaagagagaggtgtaggcatcaaaagcactcctgtgacagtggtcttgccagacaccaaaggaaaatcttatctcttcaatatcatggacactccaggacatgtgaatttctctgatgaggtcacagctggcttgcgcatctcagatggagtggtccttttcattgatgctgctgagggggtgatgctgaacacagagcggctgatcaagcatgcggtgcaggagaggctggcagtcactgtgtgcatcaacaagattgaccggctgatcctggagctgaagctgcctccaactgatgcttattacaagctgcgccacattgtggatgaggtcaatggattaataagcatgtattccactgatgagaacctgatcctttccccactcctgggtaacgtctgcttctccagctcccagtacagcatctgcttcacgctgggctcctttgccaagatctatgccgacacctttggtgacattaattaccaagaatttgctaaaagactctggggtgacatctacttcaaccctaagacgcgaaagttcaccaaaaaggccccaactagcagctcccagagaagtttcgtggagtttatcttggagcctctttataagatcctcgcccaggttgtaggtgacgtggacaccagcctcccacggaccctagacgagcttggcatccacctgacgaaggaggagctgaagctgaacatccgccccttgctcaggctggtctgcaaaaagttctttggcgagttcacaggctttgtggacatgtgtgtgcagcatatcccttctccaaaggtgggcgccaagcccaagattgagcacacctacaccggtggtgtggactccgacctcggcgaggctatgagtgactgtgaccctgatggccccctgatgtgccacactactaagatgtacagcacagatgatggagtccagtttcacgcctttggccgggtgctgagtggcaccattcatgctgggcagcctgtgaaggtactgggggagaactacaccctggaggatgaggaagactcccagatatgcaccgtgggccgcctttggatctctgtggccaggtaccacatcgaggtgaaccgtgttcctgctggcaactgggttctgattgaaggtgttgatcaaccaattgtgaagacagcaaccataaccgaaccccgaggcaatgaggaggctcagattttccgacccttgaagttcaataccacatctgttatcaagattgctgtggagccagtcaacccctcagagctgcccaagatgcttgatggcctgcgcaaggtcaacaagagctatccatccctcaccaccaaggtggaggagtctggcgagcatgtgatcctgggcactggggagctctacctggactgtgtgatgcatgatttgcggaagatgtactcagagatagacatcaaggtggctgacccagttgtcacgttttgtgagacggtggtggaaacatcctccctcaagtgctttgctgaaacgcctaataagaagaacaagatcaccatgattgctgagcctcttgagaagggcctggcagaggacatagagaatgaggtggtccagattacgtggaacaggaagaagctgggagagttcttccagaccaagtacgattgggatctgctggctgcccgttccatctgggcttttggccctgatgcgactggccccaacattctggtggatgatactctgccctctgaggtggacaaggctcttcttggttcagtgaaggacagcatcgttcaaggtttccagtggggaaccagggagggccccctctgtgatgaattgattcggaatgtcaagtttaagatcctggatgcggtggttgcccaggagcccctgcaccggggcgggggccagatcatccccacagccaggagagtcgtctactctgccttcctcatggctactcctcgtctgatggagccttactactttgtagaggtccaggcccctgcagattgcgtctctgcagtttataccgtcctggccaggcgcagggggcacgtgactcaggatgcacccatcccaggctcccctctgtacaccatcaaagcttttatcccggccatcgactcttttggctttgagactgatctccggactcacacccagggacaagccttttctctgtctgtcttccaccactggcagattgtgcctggtgatcccctggacaagagcattgtcatccgccccttggagccacagccagctcctcacctggcccgggaattcatgatcaaaacccgccgtaggaagggcctcagtgaagatgtgagcatcagcaaattcttcgatgatcctatgttgctggaacttgccaaacaggatgttgtgctcaattaccccatgtgagtgcgtggactcctgggagctcctgctccctacagtgggctgcaactcctgtacttgaagctgagacctcatatgacgtggccttcgtgttgtcagagagtgtctggaagctgctgttgccatcttgaacaactcaccaacctccaacccagagccccagtgagagaggagcatttggcctcctgcttccttctgtggcctctgccgggctccattcccaaggaaaagagaggagcttgggctcacagaaagagaaggggatgaaaccccaaggggccctatctttgggatttacatggaattttattttctacaagtttgaccttagccatggtttgcaagtgaacagaacattctg

SEQ ID NO: 129517 - DNA, 366 bp, Homo sapiens
  Payload ID: 5329
  Gene Symbol: EFTUD2
  Gene Name: elongation factor Tu GTP binding domain containing 2
  ENST ID: ENST00000591856
  CDS Start-End: 1-117
gtaacgtctgcttctccagctcccagtacagcatctgcttcacgctgggctcctttgccaagatctatgccgacacctttgaaggaactgcctggaccctggaaaggaaagtgctagaagttctcagctatgaaccacctgtggcacctgaaacagaattttgaacgacactttgctaggcgaaagttcaccaaaaaggccccaactagcagctcccagagaagtttcgtggagtttatcttggagcctctttataagatcctcgcccaggttgtaggtgacgtggacaccagcctcccacggaccctagacgagcttggcatccacctgacgaaggaggagctgaagctgaacatccgccccttg

SEQ ID NO: 129518 - DNA, 6046 bp, Homo sapiens
  Payload ID: 5330
  Gene Symbol: ELL2
  Gene Name: elongation factor, RNA polymerase II, 2
  Uniprot ID: O00472
  ENST ID: ENST00000237853
  CDS Start-End: 351-2273
taagttggcgcgtcacctagacgtcagcctcttacctctcggacgtcccgtcccaggagcaaaactctagtgactttgggcccgcccccgtgagagtggagggcggccgatgagggcggttctgaagggaacaagaccaatgagacgagcccggggcggggcgcggggccggagggtggggcgggtggcggcggtggcagtccgaggtctggctccgcgcagtatatgacagtacgtcagcagcgggatggccctagcagtggcggcggctgcagaagcccaagcagccgcggccgcagtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaagaatttaattccttttcgaccttcaatccagttccaaggactccacgggcttgtcaaaattcccaaaaatgatcccctcaatgaagttcataactttaacttttatttgtcaaatgtgggcaaagacaaccctcagggcagctttgactgcatccagcaaacattctccagctctggagcctcccagctcaattgcctgggatttatacaagataaaattacagtgtgtgcaacaaacgactcgtatcagatgacacgagaaagaatgacccaggcagaggaggaatcccgcaaccgaagcacaaaagttatcaaacccggtggaccatatgtagggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactggccctgaaggcctacaagaaaccggagctacttgctagactccagaaagatggtgtcaatcaaaaagacaagaactccctgggagcaattctgcaacaggtagccaatctgaattctaaggacctctcatataccttaaaggattatgtttttaaagagcttcaaagagactggcctggatacagtgaaatagacagacggtcattggagtcagtgctctctagaaaactaaatccgtctcagaatgctgcaggcaccagccgttcagaatctcctgtatgttctagtagagacgctgtatcttctcctcagaaacggcttttggattcagagtttattgatcctttaatgaataaaaaagcccgaatatctcacctgacgaacagagtaccaccaacactaaatggtcatttgaatcccaccagtgaaaaatctgctgcaggcctcccgctgccccctgcggctgctgccatccctacccctccaccgctgccttcaacctatctgcccatctcacatcctcctcagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattgccaagctaaataactccagtccaaattccagtggaggagttaaagaggattgcactgcctccatggaaccttcagcaattgaactcccagattatttgataaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcagaatgttcatgaagaagtcttacaagaatatcagaagataaagcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttccattttactttgcttccctgcatttcgaagctgctctttctggtcctccccaccaccccacccccaagacttgtgtttgttaatagaaataatttttttaggtattggggatccattgtctatatttcaaatcagttttttttcctcaaaaacttgtgtttgttattagaaatgattttttagatattggggatccagtgtccacacttaaaagttgtatgtgtttaaaaaacaacaacagtaatgtgcaaggtgaaatgcttttggataaacgtaagcctattttctgacgtttcttaatgcaaactctttgccttaaatggtagaatatttagaaatttgcacaaaattaaaaaaataaacattgtcttggagggttaaaaaatagaaaggtgtatgtgtatagattcacatacacatatgtatatacaggctgacttgatctagaacattaaatccgccctgcaagttaaccccccattgcaatggttgccttaaggtgtttgctagttgtgtacatagtgtggttaatcattagctacactgcttcccacttgattagagcaatgggaagcatactgtggcctaccagcatctggaagtgtgtgctcgatctgtatgtgtgcagaggtggtgtggatgtgagcgtgcatgaaggaaaaaaagctgctactcctagtaggccaaacgctcaggttaaacaactgacgagtgttactgtagggtgtttttttgtttttttgttttttttcttctatcaaattgctacttttgttgtggaagacaaaagcatttccatttcaacgagtttgtcagctttattaatgttgggcaaaaattgatatgtcatgaaaatgaaacagatctatagttttgggacaaaattataaaatgaaatgtgtaggtaacctatttatatactgctataaagtattttttgaagagagatatgcaaagaagctattacctacataagaggtatatttaaagattttttttttcatcctggtgccaggaatataaaaaagagtggatatatttaaccataacatactgtgattcatcaaacagcacaaactttcatttcatggagtttatctgttgacattgatttaaactgtcacttgttttatcatgtgggaacataagttatgtggtcaaaaatataaggattttgaattaatgttgattcaagttgtattgtcttattgtattgtcttttcaaagtgctgccagttgaaaagggaagcattatgtttacaaatctgttttgaaatgtttgccaaaattttggtagtgtctttaataaagatgtttgtctccagcatccagaaaaataaatgaataactttgttgtgtatcactgtaaaccagaaaaatgttggttatctagaaaacttgagagagcatgtagattaacttttctctttggagttctaaaacattaactggaaagattagataatatactaaatgtatacagaagtatacagactatacaaagactgaaacaagtcccttttgcactacaactctataacattaccgcagaaattttggttctatgtagcatggacctcctaaggaattctgtttcttttagcattgagatccctggtgctctttttttacctcagaattggtacaatcattattaaacgttaatttatttcaaactttttaattgaaaaaaggaaagggaaacttaattggggataaattcaggcatcatattattatgatagagtctcctgagtggttcgtctataggtaatgaactcattggtgttatttcttggacatcttggccttttaatcaaagactgtgtgctgctatttgctatgagcaaggtttctcaaaagcaaaaggtgcttggaccatttggatcacctgagttagaatctctaggtatagggcccaagtatctgcattttcacaggtttcttgtaggtgactttctgcaagctaaagtatgagaaccattggcttggatgtagttctaaacttttaggtctgtaaatcttgaaatcttgaactgaaggtcaactattggcttttttttttttttaatgtccatcatgtcagcaggtgcaaatcacttttcccctttgcatgatctgaggcacctcctcagttgtttcactgccaactcttgtttcagaacctgtttacaaacaagccttccagttggtgaatggttagccattggagctcctaccctgtacatcagcacatcttctggtttacaagttgggtaacaatgaaagctggagatgctaaatggaaatccagcattgcatacccttagacctgatcacataccagtaaaagccttaatttagatgttagttgtatgtgttggacagatccttgcaaaagtgtgtctgtctattagttgtaaatttgaaaattataaatctctgaatctgctactatccaagtttcatcccttttgaagatgaggcatgagcctattaaaatatttataatcatttttcgtcccctactgcaagacttttagattcttacaaatgattactacaggaatagtggccacttaatgtcagttactccggtggaagaatttatctagttttttttcttttcttttttggaaggatggtgtgaaaaatagcaagattagagaatgagttgtatagttttttctatcacatttcatctaaaatgatttgaaggacttttgaagatttttaccaacatccttaaatcaactccaggttggatgaacaactgatttaaaacaaactaagagaacattaactagatgtgggctttttaaaatatataggtattgcatttcctaccttgttatttattccactttgaatactttagagggcttaactttcaactctttaaggtagtaatggatagttttatacttgttctcacaaaattgttatggtcagtttatatcattgctccatgcattgattataaaaattcagtattaattttttctgatcttataagctttataggagttttcttttctcttataaagtgtttcaccttatgtaaaacaaatgcctgcttgcatattggaagatgttgaaattagttttagacaaaagtggtccatcaattcagacactctgcttggatgccttacccttttcattagtgcattctttgcttctgaaacttggcagaaactcgttagccagtccactgcctttctgacaatgtgtggagtcacgtatgcttggtatatgcctttactacttttaaagttctacagtttattacttgcccaagtgttactaaatccttttcttatgtgtactggatggagaaaaaattatagccagcactttgagaggaaagttttcagaaacaatattaactggcactactaactgaaggccacaggagatgctatcaatgttatttgtaatctgaagattgaacaaggctgtgaggctcatttcaaactattttgaggtgttaaaatatatatatgctgtttctcagctgttccactcaaaccgtgttaggactctcaaaggtaaaatgtcacaggggcttttcagttgttacagagctcagcagctgtggttgcccctgttctacaccaatttcagttcaataaaaatgttaactttgcaa

SEQ ID NO: 129519 - DNA, 468 bp, Homo sapiens
  Payload ID: 5330
  Gene Symbol: ELL2
  Gene Name: elongation factor, RNA polymerase II, 2
  ENST ID: ENST00000508757
  CDS Start-End: 1-413
ttgaggaaaaggaggaagatcttaagagagaagaggaaattgccaagctaaataactccagtccaaattccagtggaggagttaaagaggattgcactgcctccatggaaccttcagcaattgaactcccagattatttgataaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcaggtaaatggatttgtaactagatgggctgactttcatattttaccttctttctttccctgccctgctcaacctcagccatcacagtggcctttagagtaagtactcttgcagaccagcctcgctgctgctttaggaaactaaatatttgaaatag

SEQ ID NO: 129520 - DNA, 582 bp, Homo sapiens
  Payload ID: 5330
  Gene Symbol: ELL2
  Gene Name: elongation factor, RNA polymerase II, 2
  ENST ID: ENST00000513343
  CDS Start-End: 128-582
atatgacagtacgtcagcagcgggatggccctagcagtggcggcggctgcagaagcccaagcagccgcggccgcagtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaagaatttaattccttttcgaccttcaatccagttccaaggactccacggggtagccaatctgaattctaaggacctctcatataccttaaaggattatgtttttaaagagcttcaaagagactggcctggatacagtgaaatagacagacggtcattggagtcagtgctctctagaaaactaaatccgtctcagaatgctgcaggcaccagccgttcagaatctcctgtatgttctagtagagacgctgtatcttctcctcagaaacggcttttggattcagagtttattgatcctttaatgaataaaaa

SEQ ID NO: 129521 - DNA, 467 bp, Homo sapiens
  Payload ID: 5330
  Gene Symbol: ELL2
  Gene Name: elongation factor, RNA polymerase II, 2
  ENST ID: ENST00000635633
  CDS Start-End: 1-196
gctgtcgtgcggacggctggggcaggacaacatcaccgtactgcatgtgaagctcaccgagacggcgatccgggcgctcgagacttaccagagccacaagaatttaattccttttcgaccttcaatccagttccaaggactccacgggatgcctgtcttctttaaaagaacattgcaaacgtctcacaaagcctagcggtatggatctctttttttcatggagcaatgctcttgtcaaaattcccaaaaatgatcccctcaatgaagttcataactttaacttttatttgtcaaatgtgggcaaagacaaccctcagggcagctttgactgcatccagcaaacattctccagctctggagcctcccagctcaattgcctgggatttatacaagataaaattacagtgtgtgcaacaaacgactcgtatcagatgacacgagaaagaatgacccaggcagaggaggaa

SEQ ID NO: 129522 - DNA, 2453 bp, Homo sapiens
  Payload ID: 5331
  Gene Symbol: ELP2
  Gene Name: elongator acetyltransferase complex subunit 2
  Uniprot ID: Q6IA86
  ENST ID: ENST00000351393
  CDS Start-End: 44-2446
ggaagtgcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggactt

SEQ ID NO: 129523 - DNA, 2487 bp, Homo sapiens
  Payload ID: 5331
  Gene Symbol: ELP2
  Gene Name: elongator acetyltransferase complex subunit 2
  Uniprot ID: Q6IA86
  ENST ID: ENST00000350494
  CDS Start-End: 15-2480
gaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagttacctggaagactggccaggtggaacgaggcagggcctggaagccaccagcctctctcgccctctgtagcaggagctgcgactctatggtttcatgttacgcttccattctgtgcaaggctctgtggaaggagaagctgcacacattctggcatcataacagaatttcatttcttccatctgcattcaggccaataccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacagagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggactt

SEQ ID NO: 129524 - DNA, 8459 bp, Homo sapiens
  Payload ID: 5331
  Gene Symbol: ELP2
  Gene Name: elongator acetyltransferase complex subunit 2
  Uniprot ID: Q6IA86
  ENST ID: ENST00000358232
  CDS Start-End: 64-2544
agtagttccgctccgagggcggaagtgcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttttttttttttttgagatggagtcttgctttgtcacaacctccacctcccaggttcaagcgattctctttcttcagcctcctgagtagctgggactagaggcacaccaccaattccggctaatttttgtatttttagtagagactgggtttcaccgttggccaggcgggtctcaaactcctcgtctcaggtgatctgcttgcctcggcctcccaaagtgctgggattacaggcgtgagccactgcgcccagcctgagtttcattttttaagtcacatagcagtagtccttatttcagtgctagaccctttgaaatgcgatgaaagctatatggacccttcgctttgttatataacatatgcacacatacccagaattttgcacatatgttcagagattcctagacctgcagacctgcctctgtgtgtcccaatttaagaacctctgttctttcttcatgactggatttgcccaattttgtgttattttgggacttaatttgtccctctttgggacatttccttatttattgccctcttcagagagtagatgtagaaaataaagagaggaaacctagattacttaattttattttaacattttctatagatagcataccacgccaagtgtgctctgtcttgatccccttctttctagcatctgccagacattgtagagtttcgcaagcagttgtaggtttgagctgcagccagtcatttcttttattctttaaaagtacatagatttgtctttttagggctttactgaaagtaaaatatcctgacatttaaactgacagatgtaggaggtaaaaaatagagttctgaaacatttgaatttatgtgacagctgaagtcacgagatgagggatatatgtcccccagggaggatgcagaaagaagaaaagggtactggaaacagcatgtcagtggtgccagctgagggctggaggcagccaggagagttgggagcctgggtgctgggtggagagaggttaacagggaagacatgggaagtattgtgaaggctggtgtgagcaggggactactccagccctgttggaacatagagccatttggcagattgacaatgcagtgacagctgtatataataaatgtgttgaaaggaggaaggtgaggattttcttggtgggagtttatgctgttatttaacatattttgcttccaaaggggttaagatgttttacctaaatggaggtttctaggtcagtgctatacaatatttctaatctgtgttttatagtgtgagctacatatgtaattttaaaattttcaagtagccacataataaaggaaacaggtgaaatttaatgacatatttcctttaatacggtatatccaaaatattattatgtcaacctataatcagtataaaaacctgttactgaaatattttatagggcccatctcagttcagactagccacatttaagtgcttcatagccacatgtggctcatggccatccatatttggacaatgtactttagactattgcatctgtatactcttgtgccgtcagctggggggtggggtgtgtgtgcgtgtataccaaggcagtgagcatctgagctttgaacctcaaagaccaaaatgccctgcccattttcctgcttatcagctgaggaatctttacccacattgacacatgggcttgttctgacccaagtgcatgcaggcttccagagcagattcagaggcctaacttagtcctttagctttcctcccagcacagaactcccaaggttatctgcaagtaggccttgcctagagagactgagttttcaagttgtcagttttcccaaattgtcctcaagcatcttcctctggaatcaccttactgtttagtaaacattcagaggacttgctacacatctgggcagtctgcattgtaattcatatgtgtttacacatttgtgtcttcatctgctaaagcacctttgaaccatattgtaattcataatatctgaagcaattattatgaattgtagtaattcataatattgaagcgattcataatatctgaagcaatccccagatacgggttaggcatggccctgctctgagcaggatggcaaaagtggcagtccgtgacgcagcccttgttaccccaggctattactaaatggtggtggtggttttatcttaattaaaatgacatcaccaacaatgggccctttcctgtctgccaggaaaagttttctgtagtgacgcacgtgttgtgtgtgtatgtgtgcgtttgaggctatattactcattgctacggcagttcaaaatgacttggaaaaaaacaatgaacgctggtcattgatatgtatactgacatgtttgagggaagttactgtggtctgtaacttatgaaatacataaaaaatatgatgggtggagtgacggacacatggacagatatgaagcaagcactgtaaaatattagtggtagtttttgtatgcccatactcacggcaccattattcacagtagctaagagatggaagcaatatgtgcccatcagtgggtgaatgatcaacaaaatgtggtatattcatacagtggaatattattcagcctctaaaaggaagatacgctgacatgtgctgcaacatggatgaatcttgaggacatgatgctaagtgaagtaagccagtcactggaagacaaatactctatgcttccatttatgtgaagtatctagagcagtcaaatgcatagaaacaagtagaatggtagttgccaaggactgggggaggaggaaatgaggagttgtttaatgggtatagtgtttcagttttgcaagataaaaagtcctgtggattggttgcacagttaagttatgtgaatgctgtatgccaactcaactgtacactctaaaatggttaagatggtaaatcttatctttattttaccacagttttttttaaagcatggtaaacaccatttcccaggatgtaaatcggtactaaaaaaaaagtgctccaaagtaagatatatttgggaaacacagggataactaaggttagataggtgttctttattgcaggaattctaagagcatttaacaaattaatttacactgggaattttcagtgtggagggtctggctcatagcatttcacaaacattatacttcagagtcccaaagcctttaaataaaatgttaatggtagaaactccttaaggggtgttcactgtacaattctttcaacttttctgcatgctgggagtttttttggtaacaacgtgttggggaaaatggccttggaatatttcattcaaattggagccaagctaacacaaagctgttgctgctagtgggaacagccctgatgtccatgtaacaagctgccctccccaactccctccttcctgtttctccctcctcggcacccacttctaggattaacaggcagggagacgggagagcccagctctgggtacagttgggccacagcagaaggagggccagggtagaggtttgggccttggctctgatgcttgaacataaacacacctagtcagaagtacatcagtacaaagtgggccctacaaaattatagggtcagaaaacaggtaagtggttaccaggggctgggaatggggagaggagtgactacagagggacctagattcttcaacaaatacattacaagaggaaaagggaagggaagggaagcctggagattgaaagatacttgagacgtgtgaatccagtgcaatgtatgaaccttgtttgcctcttgatctgaactagccaatcaatcttgtaaaaatgtgcttaagggacaaagcaaatttgaactctggctggatatttgatgatattaaggaaacaacatttaaacatatgacagtggggctatggttatgattggttttgttttttttttctctagagactgggttttgcagtgttacctaagctggtcttgaactcctgggctcaagcagttctcccacctcagccttggtttaagaaaaaaaaaaaaaaagttctcttgaatcataatttcagtatttatggatgaaatcaatttatgtcttgggttgtttcataatgattgtgtgtgtgtcaaggactagatgggttttagatgtgtggattattaatgaagctgggcagtgttggggtggtcatactattctaattttttaatatacttaaaatttccttataagaattgtttagaaagaatgagcatatccataagttaaatacaaaaattgttacattgtgaggagttcttccccttctagcatgtagtggatggtccagtattaaggctctgccatgcttaaacaagagactggcactccaaggacaatgaggctgaggccagaagagagacagcgtgttggatggctgcatgtggttggtggatagaggactctgagccccactctggtggactcagagatctgggacccgggccgggcgtggtggctcatgcctgtaatcccagcaatttgggaggctgaggcgggtggatcacttgaggtcaggagttcgagaccagcctggccaacatggtgaaaccccatctctactaaaaatacaaaaaaaaaaaaaaaattagtcgggcatggtggtgggcgcctgtaatcccagatgttccagaggctgaggcaggagaaccgcttgaacccaggaggaggaggaggttgcagtgggccgagatcgagccactgcactccagcctgggcaacagagtgagactccatctcaaaaaaaaaaaaaaaaaaaaaaaaaatctgggacccagtactgagtgaagacaccagagtgaaggagagaggccatgctgtgtccgagaagctcctactggggtggaagggacagctccacaaaggctgctcttgcaggggctctcctgcagcaaggtgcctgctgactgtccccagactgtctcccgacacagagggatgcaaaggcagcctcttcctgctcagtggaatagggaaattatatcacctttcacttcccactctcacttctgcccctgctacccttagtctttggcttttgctgacattttcccctcttatcttttctcctgaccaagttctaggtatttcatagggcagtctaggtgagggttggaaccccaatgagttgggcaacagaaacccagctcacactggctgtcactgtgggcaagctgttcccctcatctctaaaagtggagatgagattagtgtatgagtctggcttccattcaactgtgtgtgaaaaaaaattgtaaaattttctttctggtttacgcaagttaaaagtttatttctctcatatgaaaggagtcaaggcagacagaccaggatggggagggagatgtctacagggtcaaggacccaggctcttatttcgctgtctgacgtccttagtatgaggctttcaccttccaggatggctgcttggcctcctgccatggtctttgcgttccagccagcaaagaggaagaaggcatgaagaaaggcctgcccctgactttaaaaacatttcttggaagtcccatactattttgcttaatctcctcgggcagaatttagtgttgtggccataccgagcttcaggagaagctgggaaattaaatctttattgcagatgcccatgtgctcagcagagaactggggtgcttcattctggaagaaagggagaacaacagtaaccagtgtgtaggattgttctgagaattaaatgagccaatatatgaaaaacactagtttggtccctgggatataaataagacagcagtaatttgtatctggtactattatgattaaataaagctctgctcgtgtcaactcc

SEQ ID NO: 129525 - DNA, 2385 bp, Homo sapiens
  Payload ID: 5331
  Gene Symbol: ELP2
  Gene Name: elongator acetyltransferase complex subunit 2
  Uniprot ID: Q6IA86
  ENST ID: ENST00000423854
  CDS Start-End: 36-2306
gcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaaggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataa

SEQ ID NO: 129526 - DNA, 2722 bp, Homo sapiens
  Payload ID: 5331
  Gene Symbol: ELP2
  Gene Name: elongator acetyltransferase complex subunit 2
  Uniprot ID: Q6IA86
  ENST ID: ENST00000442325
  CDS Start-End: 37-2712
cgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgttacctggaagactggccaggtggaacgaggcagggcctggaagccaccagcctctctcgccctctgtagcaggagctgcgactctatggtttcatgttacgcttccattctgtgcaaggctctgtggaaggagaagctgcacacattctggcatcataacagaatttcatttcttccatctgcattcaggccaataccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaat

SEQ ID NO: 129527 - DNA, 569 bp, Homo sapiens
  Payload ID: 5331
  Gene Symbol: ELP2
  Gene Name: elongator acetyltransferase complex subunit 2
  ENST ID: ENST00000545632
  CDS Start-End: 40-195
gtgcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaa

SEQ ID NO: 129528 - DNA, 535 bp, Homo sapiens
  Payload ID: 5331
  Gene Symbol: ELP2
  Gene Name: elongator acetyltransferase complex subunit 2
  ENST ID: ENST00000543127
  CDS Start-End: 364-535
gcttttccgtgtgttcgccgacgccgcgggggcgtggcgcggccctagcgcattaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatg

SEQ ID NO: 129529 - DNA, 553 bp, Homo sapiens
  Payload ID: 5331
  Gene Symbol: ELP2
  Gene Name: elongator acetyltransferase complex subunit 2
  ENST ID: ENST00000544267
  CDS Start-End: 55-210
gctccgagggcggaagtgcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaaca

SEQ ID NO: 129530 - DNA, 1049 bp, Homo sapiens
  Payload ID: 5331
  Gene Symbol: ELP2
  Gene Name: elongator acetyltransferase complex subunit 2
  ENST ID: ENST00000540766
  CDS Start-End: 1-144
gatgaagaggagctgttaactagtactggttttgagtatcagcaggtggcctttcagccctccatacttactgagcctcccactgaggatcatcttctgcagaatactttgtggcctgaagttcaaaaactagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttttttttttttttgagatggagtcttgctttgtcacaacctccacctcccaggttcaagcgattctctttcttcagcctcctgagtagctgggactagaggcacaccaccaattccggctaatttttgtatttttagtagagactgggtttcaccgttggccaggcgggtctcaaactcctcgtctcaggtgatctgcttgcctcggcctcccaaagtgctgggattacaggcgtgagccactgcgcccagcctgagtttcattttttaagtcacatagcagtagtccttatt

SEQ ID NO: 129531 - DNA, 649 bp, Homo sapiens
  Payload ID: 5331
  Gene Symbol: ELP2
  Gene Name: elongator acetyltransferase complex subunit 2
  ENST ID: ENST00000542430
  CDS Start-End: 18-380
gctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggt

SEQ ID NO: 129532 - DNA, 2542 bp, Homo sapiens
  Payload ID: 5331
  Gene Symbol: ELP2
  Gene Name: elongator acetyltransferase complex subunit 2
  Uniprot ID: Q6IA86
  ENST ID: ENST00000539560
  CDS Start-End: 34-2151
gtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataac

SEQ ID NO: 129533 - DNA, 2288 bp, Homo sapiens
  Payload ID: 5331
  Gene Symbol: ELP2
  Gene Name: elongator acetyltransferase complex subunit 2
  Uniprot ID: Q6IA86
  ENST ID: ENST00000542824
  CDS Start-End: 11-2281
agttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacagagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggactt

SEQ ID NO: 129534 - DNA, 381 bp, Homo sapiens
  Payload ID: 5331
  Gene Symbol: ELP2
  Gene Name: elongator acetyltransferase complex subunit 2
  ENST ID: ENST00000540799
  CDS Start-End: 10-315
gttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagatatgggcacggttatgaaatattttgtgttacttgtaacagttcaaagactctgcttgcctcagcttgtaaggcagctaagaa

SEQ ID NO: 129535 - DNA, 3452 bp, Homo sapiens
  Payload ID: 5332
  Gene Symbol: ELP3
  Gene Name: elongator acetyltransferase complex subunit 3
  Uniprot ID: Q9H9T3
  ENST ID: ENST00000256398
  CDS Start-End: 378-2021
gagagaccatccacttccaccctttcacttaggcttcctggcgcagcctctatccaggaactctgtcccatagctgtactgcccaggtcgagctttctaaccccaagatgccactccgttcagacgttcccatcctccatccctgagacccggggcaggatcgcagcctaggggcctcacgggccgcctgctaccctgttagttgcaacacggggcggggcgtggctttgtgcacgtcggcttccgggaagagctttacgatacattgaccgacattttacgacaggcgggattgttttgtggctgtcagctttccccgtggtctgagtttgtggctgcatttttatctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatacaaagaa

SEQ ID NO: 129536 - DNA, 3078 bp, Homo sapiens
  Payload ID: 5332
  Gene Symbol: ELP3
  Gene Name: elongator acetyltransferase complex subunit 3
  Uniprot ID: Q9H9T3
  ENST ID: ENST00000380353
  CDS Start-End: 286-1653
gtgcacgtcggcttccgggaagagctttacgatacattgaccgacattttacgacaggcgggattgttttgtggctgtcagctttccccgtggtctgagtttgtggctgcatttttatctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatac

SEQ ID NO: 129537 - DNA, 874 bp, Homo sapiens
  Payload ID: 5332
  Gene Symbol: ELP3
  Gene Name: elongator acetyltransferase complex subunit 3
  ENST ID: ENST00000523357
  CDS Start-End: 1-423
agaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtggatgtcctggggcagaggcagaggggaggccaccacagaagctgttcactctaggcactttgcaaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattc

SEQ ID NO: 129538 - DNA, 1924 bp, Homo sapiens
  Payload ID: 5332
  Gene Symbol: ELP3
  Gene Name: elongator acetyltransferase complex subunit 3
  ENST ID: ENST00000519261
  CDS Start-End: 192-317
gctgtcagctttccccgtggtctgagtttgtggctgcatttttatctctggtggctctgctacggcggcgcagaaatgaggcagaagcggaaagggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagc

SEQ ID NO: 129539 - DNA, 3158 bp, Homo sapiens
  Payload ID: 5332
  Gene Symbol: ELP3
  Gene Name: elongator acetyltransferase complex subunit 3
  Uniprot ID: Q9H9T3
  ENST ID: ENST00000521015
  CDS Start-End: 126-1727
cgaagcttcaggagacctatcctcatctgtgcaaggaggagtggccaactctggagcccaggctgttgcttcctggtctggtggtgaatcctccatagtctggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatacaaagaa

SEQ ID NO: 129540 - DNA, 656 bp, Homo sapiens
  Payload ID: 5332
  Gene Symbol: ELP3
  Gene Name: elongator acetyltransferase complex subunit 3
  ENST ID: ENST00000521570
  CDS Start-End: 82-656
ccaactctggagcccaggatgttgcttcccggtctggtggtgaatcctccatagtctggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaa

SEQ ID NO: 129541 - DNA, 1914 bp, Homo sapiens
  Payload ID: 5332
  Gene Symbol: ELP3
  Gene Name: elongator acetyltransferase complex subunit 3
  ENST ID: ENST00000524103
  CDS Start-End: 220-1647
attttacgacaggcgggattgttttgtggctgtcagctttccccgtggtctgagtttgtggctgcatttttatctctggtggctctgctacggcggcgcagaaatgaggcagaagcggaaagggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatg

SEQ ID NO: 129542 - DNA, 566 bp, Homo sapiens
  Payload ID: 5332
  Gene Symbol: ELP3
  Gene Name: elongator acetyltransferase complex subunit 3
  ENST ID: ENST00000520288
  CDS Start-End: 163-566
agaagcggaaaggtgcgaaaggggaaggagatgggggaaaggggtggtccgaaaggggcgaacgcccaggcaatcaaatgctgaaccgaacttttaccgcgagaatccgctacccagtccagtcgccccgccacctagggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaag

SEQ ID NO: 129543 - DNA, 545 bp, Homo sapiens
  Payload ID: 5332
  Gene Symbol: ELP3
  Gene Name: elongator acetyltransferase complex subunit 3
  ENST ID: ENST00000520270
  CDS Start-End: 207-545
aatagtaaactgacatggcatactggtgggcatcttatggaaagttgcttccacccctgccctgtttcagctagtcctcaacttgatccagtgtccaaactctgcctccagaacagagtcccacttcctacctcacatggtctgtgacagagccccaggggatcctgagaacatgtgtccaaggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttac

SEQ ID NO: 129544 - DNA, 2059 bp, Homo sapiens
  Payload ID: 5332
  Gene Symbol: ELP3
  Gene Name: elongator acetyltransferase complex subunit 3
  ENST ID: ENST00000518112
  CDS Start-End: 77-214
ggctgtcagctttccccgtggtctgagtttgtggctgcatttttatctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgc

SEQ ID NO: 129545 - DNA, 545 bp, Homo sapiens
  Payload ID: 5332
  Gene Symbol: ELP3
  Gene Name: elongator acetyltransferase complex subunit 3
  ENST ID: ENST00000521099
  CDS Start-End: 227-545
ggcagtcacgtggtgtcttgtttgaatggcagggaaaccattattccaatatatgccctccgaggagttaacgtcgatttaacgggttgtaggacttttcatttgttaagatttgtttcacgacacatttgacgtgttagagagtttcttttaaagccttattttaagatattaaaaaaaccttaattatccttggattcagtgagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttg

SEQ ID NO: 129546 - DNA, 1923 bp, Homo sapiens
  Payload ID: 5332
  Gene Symbol: ELP3
  Gene Name: elongator acetyltransferase complex subunit 3
  ENST ID: ENST00000523687
  CDS Start-End: 114-251
attgaccgacattttacgacaggcgggattgttttgtggctgtcagctttccccgtggtctgagtttgtggctgcatttttatctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaattgctgtcgtggctgtgatgtgcaaaccccacagatgtccacacatcagttttacaggaaatatatgtgtccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagc

SEQ ID NO: 129547 - DNA, 680 bp, Homo sapiens
  Payload ID: 5332
  Gene Symbol: ELP3
  Gene Name: elongator acetyltransferase complex subunit 3
  ENST ID: ENST00000517975
  CDS Start-End: 1-201
atccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcga

SEQ ID NO: 129548 - DNA, 3053 bp, Homo sapiens
  Payload ID: 5332
  Gene Symbol: ELP3
  Gene Name: elongator acetyltransferase complex subunit 3
  Uniprot ID: Q9H9T3
  ENST ID: ENST00000537665
  CDS Start-End: 342-1628
gtgcacgtcggcttccgggaagagctttacgatacattgaccgacattttacgacaggcgggattgttttgtggctgtcagctttccccgtggtctgagtttgtggctgcatttttatctctggtggctctgctacggcggcgcagaaatgaggcagaagcggaaagggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatac

SEQ ID NO: 129549 - DNA, 1784 bp, Homo sapiens
  Payload ID: 5333
  Gene Symbol: ELP4
  Gene Name: elongator acetyltransferase complex subunit 4
  Uniprot ID: Q96EB1
  ENST ID: ENST00000350638
  CDS Start-End: 36-1310
agagttcctattgggttaacactggaggctctaagatggcggcagtggcaacctgcggtagtgttgccgcgagtactgggtctgcagtggcgacagccagcaagagcaacgtcaccagtttccagaggaggggtcctagagccagcgtgaccaacgacagcggccctcgactggtgtccattgcgggcacgcgaccgtcggtgcggaatggacagctgctggtatcaaccgggctcccagccctagaccagctcttaggtggaggtttagccgttggaacagttcttctaattgaggaggataaatataatatttactcacctttgctcttcaagtatttcctggcagaaggaattgtcaatgggcatactttgttggttgcatctgctaaagaggatcctgccaacattttacaggaacttccagcaccattacttgatgataaatgtaaaaaggaatttgatgaagatgtatacaatcataaaacaccagaatctaatattaagatgaaaatagcttggcgttaccagttattacccaagatggagattggaccagtatcatcttcaagatttggtcactattatgatgcatcaaaaagaatgccacaagaactaattgaggcttcaaattggcatggattttttcttccagagaaaatatcttcaactctcaaagtagaaccctgttctttgacccctggctacacaaagctgcttcagtttatccagaacatcatttatgaggaaggatttgatggatccaatcctcagaaaaaacagagaaacattttaagaataggaattcagaatcttggctcacctttatggggagacgatatttgctgtgcagaaaatggtggcaacagtcacagccttaccaagttcctctatgttctccgtggtcttctgagaacctctctttcagcctgcatcatcacaatgccaacacatctgatccagaataaagccattattgcccgtgtcacaaccttgtcagatgtagtagttggtctggaatcatttattggttctgagagagaaactaacccattgtataaggattatcatggattgattcatatacggcagattcctcggcttaataacttgatctgtgatgaatcagatgtcaaagacttagcttttaaattaaaaaggaagctattcaccattgagcgactgcatttgcctccagacttgtcagacacagtgagccgctcaagcaaaatggatctggcagaatccgccaagcggctgggcccaggctgtggcatgatggccggaggcaagaagcacctggacttctagggattcctccttagtcgctgcatgcagaattctatgacactctaattatgattgctaatagcttatgtaaatatttttcttaacaatttgaccctccactccttgaaaaacacaggattataaaatggtgccgccatttctcattttttaactttttacagaactagcacagcagaaatacttttaaatttttccttcatgctctagagaaaataattttatttttaaataaacgccaaaaaatgtcaaaatctcaagattcctgacagtggtcattcgtgtgtgtactaaggcatttagtgtcatggtaaagtgcatgtcacagcaggtagcatacaaaacatgatgaaattcaagattgtatgtgaaaacatactttctctttattacagaaacagtcacttgccaccaaaaatgctgttttttaaatgaaaatgtgtttactaatatataaaataaatttgcatttatgta

SEQ ID NO: 129550 - DNA, 1679 bp, Homo sapiens
  Payload ID: 5333
  Gene Symbol: ELP4
  Gene Name: elongator acetyltransferase complex subunit 4
  Uniprot ID: Q96EB1
  ENST ID: ENST00000379163
  CDS Start-End: 16-1446
actggaggctctaagatggcggcagtggcaacctgcggtagtgttgccgcgagtactgggtctgcagtggcgacagccagcaagagcaacgtcaccagtttccagaggaggggtcctagagccagcgtgaccaacgacagcggccctcgactggtgtccattgcgggcacgcgaccgtcggtgcggaatggacagctgctggtatcaaccgggctcccagccctagaccagctcttaggtggaggtttagccgttggaacagttcttctaattgaggaggataaatataatatttactcacctttgctcttcaagtatttcctggcagaaggaattgtcaatgggcatactttgttggttgcatctgctaaagaggatcctgccaacattttacaggaacttccagcaccattacttgatgataaatgtaaaaaggaatttgatgaagatgtatacaatcataaaacaccagaatctaatattaagatgaaaatagcttggcgttaccagttattacccaagatggagcagattggaccagtatcatcttcaagatttggtcactattatgatgcatcaaaaagaatgccacaagaactaattgaggcttcaaattggcatggattttttcttccagagaaaatatcttcaactctcaaagtagaaccctgttctttgacccctggctacacaaagctgcttcagtttatccagaacatcatttatgaggaaggatttgatggatccaatcctcagaaaaaacagagaaacattttaagaataggaattcagaatcttggctcacctttatggggagacgatatttgctgtgcagaaaatggtggcaacagtcacagccttaccaagttcctctatgttctccgtggtcttctgagaacctctctttcagcctgcatcatcacaatgccaacacatctgatccagaataaagccattattgcccgtgtcacaaccttgtcagatgtagtagttggtctggaatcatttattggttctgagagagaaactaacccattgtataaggattatcatggattgattcatatacggcagattcctcggcttaataacttgatctgtgatgaatcagatgtcaaagacttagcttttaaattaaaaaggaagctattcaccattgagtgggtgcaagacaactacttgagacaagagaggaacatttatcctccaggcttctcatacttactcaagcagaaagactctgcatggggagaaggttctttacagcattccacatttttaatgagcttccttgcaaaggcgactgcatttgcctccagacttgtcagacacagtgagccgctcaagcaaaatggatctggcagaatccgccaagcggctgggcccaggctgtggcatgatggccggaggcaagaagcacctggacttctagggattcctccttagtcgctgcatgcagaattctatgacactctaattatgattgctaatagcttatgtaaatatttttcttaacaatttgaccctccactccttgaaaaacacaggattataaaatggtgccgccatttctcattttttaactttttacagaactagcacagcagaaatacttttaaatttttccttcatgctctagagaaaataattttatttttaaataaacgccaaaaaatgtc

SEQ ID NO: 129551 - DNA, 1961 bp, Homo sapiens
  Payload ID: 5333
  Gene Symbol: ELP4
  Gene Name: elongator acetyltransferase complex subunit 4
  ENST ID: ENST00000395934
  CDS Start-End: 8-1615
ctctaagatggcggcagtggcaacctgcggtagtgttgccgcgagtactgggtctgcagtggcgacagccagcaagagcaacgtcaccagtttccagaggaggggtcctagagccagcgtgaccaacgacagcggccctcgactggtgtccattgcgggcacgcgaccgtcggtgcggaatggacagctgctggtatcaaccgggctcccagccctagaccagctcttaggtggaggtttagccgttggaacagttcttctaattgaggaggataaatataatatttactcacctttgctcttcaagtatttcctggcagaaggaattgtcaatgggcatactttgttggttgcatctgctaaagaggatcctgccaacattttacaggaacttccagcaccattacttgatgataaatgtaaaaaggaatttgatgaagatgtatacaatcataaaacaccagaatctaatattaagatgaaaatagcttggcgttaccagttattacccaagatggagattggaccagtatcatcttcaagatttggtcactattatgatgcatcaaaaagaatgccacaagaactaattgaggcttcaaattggcatggattttttcttccagagaaaatatcttcaactctcaaagtagaaccctgttctttgacccctggctacacaaagctgcttcagtttatccagaacatcatttatgaggaaggatttgatggatccaatcctcagaaaaaacagagaaacattttaagaataggaattcagaatcttggctcacctttatggggagacgatatttgctgtgcagaaaatggtggcaacagtcacagccttaccaagttcctctatgttctccgtggtcttctgagaacctctctttcagcctgcatcatcacaatgccaacacatctgatccagaataaagccattattgcccgtgtcacaaccttgtcagatgtagtagttggtctggaatcatttattggttctgagagagaaactaacccattgtataaggattatcatggattgattcatatacggcagattcctcggcttaataacttgatctgtgatgaatcagatgtcaaagacttagcttttaaattaaaaaggaagctattcaccattgaggctggagtgcagtggcacgatctcggctcacggcaacctcgcctcctgggttcaagcaattctcccgcctcagcctccctagtagctgggattacaggcgcccaccaccacacccagctaatttttgtatttttagtagagatggggttccaccatgttggccaggctggtctcgaactcctgacctcaggtgattcatccgcctcagcctcccaaagtgctggaattacaggcatgagctaccgcgcccggcctagggctttgtatttcaaagagaacaagtctaaagtgggtgcaagacaactacttgagacaagagaggaacatttatcctccaggcttctcatacttactcaagcagaaagactctgcatggggagaaggttctttacagcattccacatttttaatgagcttccttgcaaaggcgactgcatttgcctccagacttgtcagacacagtgagccgctcaagcaaaatggatctggcagaatccgccaagcggctgggcccaggctgtggcatgatggccggaggcaagaagcacctggacttctagggattcctccttagtcgctgcatgcagaattctatgacactctaattatgattgctaatagcttatgtaaatatttttcttaacaatttgaccctccactccttgaaaaacacaggattataaaatggtgccgccatttctcattttttaactttttacagaactagcacagcagaaatacttttaaatttttccttcatgctctagagaaaataattttatttttaaataaacgccaaaaaatgtcaaaa

SEQ ID NO: 129552 - DNA, 1161 bp, Homo sapiens
  Payload ID: 5333
  Gene Symbol: ELP4
  Gene Name: elongator acetyltransferase complex subunit 4
  ENST ID: ENST00000474374
  CDS Start-End: 15-572
ctggaggctctaagatggcggcagtggcaacctgcggtagtgttgccgcgagtactgggtctgcagtggcgacagccagcaagagcaacgtcaccagtttccagaggaggggtcctagagccagcgtgaccaacgacagcggccctcgactggtgtccattgcgggcacgcgaccgtcggtgcggaatggacagctgctggtatcaaccgggctcccagccctagaccagctcttaggtggaggtttagccgttggaacagttcttctaattgaggaggataaatataatatttactcacctttgctcttcaagtatttcctggcagaaggaattgtcaatgggcatactttgttggttgcatctgctaaagaggatcctgccaacattttacaggaacttccagcaccattacttgatgataaatgtaaaaaggaatttgatgaagatgtatacaatcataaaacaccagaatctaatattaagatgaaaatagcttggcgttaccagttattacccaagatggaggcaaattggaccagtatcatcttcaagatttggtcactattatgatgcatcaaaaagaatgccacaagaactaattgaggcttcaaattggcatggattttttcttccagagaaaatatcttcaactctcaaagtagaaccctgttctttgacccctggctacacaaagctgcttcagtttatccagaacatcatttatgaggaaggatttgatggatccaatcctcagaaaaaacagagaaacattttaagaataggaattcagaatcttggctcacctttatggggagacgatatttgctgtgcagaaaatggtggcaacagtcacagccttaccaagttcctctatgttctccgtggtcttctgagaacctctctttcagcctgcatcatcacaatgccaacacatctgatccagaataaagccattattgcccgtgtcacaaccttgtcagatgtagtagttggtctggaatcatttattggttctgagagagaaactaacccattgtataaggattatcatggattgattcatatacggcagattcctcggcttaataacttgatctgtgatgaatcagatgtcaaagacttagcttttaaattaaaaaggaagctattcaccattgag

SEQ ID NO: 129553 - DNA, 1304 bp, Homo sapiens
  Payload ID: 5334
  Gene Symbol: ELP5
  Gene Name: elongator acetyltransferase complex subunit 5
  Uniprot ID: Q8TE02
  ENST ID: ENST00000354429
  CDS Start-End: 108-1058
actaagttcctcctgcgcggtctatggcggactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttatt

SEQ ID NO: 129554 - DNA, 2197 bp, Homo sapiens
  Payload ID: 5334
  Gene Symbol: ELP5
  Gene Name: elongator acetyltransferase complex subunit 5
  Uniprot ID: Q8TE02
  ENST ID: ENST00000356683
  CDS Start-End: 215-1054
gggagagtgacgtcacttggcccgcgcttagggccctcgcggggggcttgtgggtcctcctccccctcccactgacaactgccccaactgctcttcccgccccggtcacagtgaaaatgtagacggggtcgttgtccactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtatctaagaatgccaaggccagaacaaggaaatgtagtttagtatctggtcacgggagagaaaataaaagctgcagaggttgggggtggggtcagggattctagggatggggcagagtggcagcatcctttgtacctacaggtggatcccacaactcatttgacctttaaccttcacctgtccaagaaagagagagaagccagagatagcctgatcctgcccttccagttcagttctgaaaagtaaggttgggacctgggtacgtggatccctgagtagatcccagcatctgggccatggagaggttggggcaacaggttattgattaacctgactttatagggactgaagtccacctccagagacaagtccaagttcttgatccacccattccccctataatggcagaggacctttatgtctcttttctctcccttatacccttgggtcacagctccagttgtccccagagcaccctgggcctgggctgagccagaccagacccttgggaggtggccctatccctaggcagtggtgctaggaggacagaaggctatatgggcgtggcagaggctggttaacaagggcttagtacacgcttgctgttctgtgcccagtatgtgggcggatgacgcaagactacaagatccttgccctcaagctgctaggaacttacggttttattaggagagcagtacaagggtatctatcccagtaccaaatggtgcttcagctctaacatggaggtcagagaaagggacttggaccaataaaatgacatggaggcctaacaggttgcctgaatgagagtcacagtcacctggaagaaagtatccagacccaacctgttagctaccctcaccagcaccaaatcttcccttctcagacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttatt

SEQ ID NO: 129555 - DNA, 1389 bp, Homo sapiens
  Payload ID: 5334
  Gene Symbol: ELP5
  Gene Name: elongator acetyltransferase complex subunit 5
  Uniprot ID: Q8TE02
  ENST ID: ENST00000396627
  CDS Start-End: 184-1134
ggccctcgcggggggcttgtgggtcctcctccccctcccactgacaactgccccaactgctcttcccgccccggtcacagtgaaaatgtagacggggtcgttgtccactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaagaa

SEQ ID NO: 129556 - DNA, 1423 bp, Homo sapiens
  Payload ID: 5334
  Gene Symbol: ELP5
  Gene Name: elongator acetyltransferase complex subunit 5
  Uniprot ID: Q8TE02
  ENST ID: ENST00000396628
  CDS Start-End: 218-1168
aactgctcttcccgccccggtcacagtgaaaatgtagacggggtcgttgtccgtacgactgtgcgccagggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaagaa

SEQ ID NO: 129557 - DNA, 473 bp, Homo sapiens
  Payload ID: 5334
  Gene Symbol: ELP5
  Gene Name: elongator acetyltransferase complex subunit 5
  ENST ID: ENST00000570500
  CDS Start-End: 187-473
tcgcggggggcttgtgggtcctcctccccctcccactgacaactgccccaactgctcttcccgccccggtcacagtgaaaatgtagacggggtcgttgtccgtacgactactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactga

SEQ ID NO: 129558 - DNA, 937 bp, Homo sapiens
  Payload ID: 5334
  Gene Symbol: ELP5
  Gene Name: elongator acetyltransferase complex subunit 5
  ENST ID: ENST00000576496
  CDS Start-End: 1-788
tggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaagtaaggttgggacctgggtacgtggatccctgagtagatcccagcatctgggccatggagaggttggggcaacaggttattgattaacctgactttatagggactgaagtccacctccagagacaagtccaagttcttgatccacccattccc

SEQ ID NO: 129559 - DNA, 416 bp, Homo sapiens
  Payload ID: 5334
  Gene Symbol: ELP5
  Gene Name: elongator acetyltransferase complex subunit 5
  ENST ID: ENST00000572104
  CDS Start-End: 1-325
gctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctgactcagtggttctccatccttccggacttcagcctggatctccaagaggggccctctgtagagtcccagccctactccgatcctcatatacccccggtatctaagaatgccaaggccagaacaaggaaatgtagtttagtatctggtcacgggagagaaaataaaagctgcagaggttgggggtggggtcaggga

SEQ ID NO: 129560 - DNA, 890 bp, Homo sapiens
  Payload ID: 5334
  Gene Symbol: ELP5
  Gene Name: elongator acetyltransferase complex subunit 5
  ENST ID: ENST00000571146
  CDS Start-End: 1-354
gattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtatctaagaatgccaaggccagaacaaggaaatgtagtttagtatctggtcacgggagagaaaataaaagctgcagaggttgggggtggggtcagggattctagggatggggcagagtggcagcatcctttgtacctacaggtggatcccacaactcatttgacctttaaccttcacctgtccaagaaagagagagaagccagagatagcctgatcctgcccttccagttcagttctgaaaagtaaggttgggacctgggtacgtggatccctgagtagatccc

SEQ ID NO: 129561 - DNA, 687 bp, Homo sapiens
  Payload ID: 5334
  Gene Symbol: ELP5
  Gene Name: elongator acetyltransferase complex subunit 5
  Uniprot ID: Q8TE02
  ENST ID: ENST00000573657
  CDS Start-End: 128-667
cgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgagacccctccttcattgtttcccctcatacatctccctctgccaaggagtgtgccccttttcctttctaccctagaataaacatctgggttctccagtca

SEQ ID NO: 129562 - DNA, 2209 bp, Homo sapiens
  Payload ID: 5334
  Gene Symbol: ELP5
  Gene Name: elongator acetyltransferase complex subunit 5
  Uniprot ID: Q8TE02
  ENST ID: ENST00000574993
  CDS Start-End: 218-1057
aactgctcttcccgccccggtcacagtgaaaatgtagacggggtcgttgtccgtacgactgtgcgccagggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtatctaagaatgccaaggccagaacaaggaaatgtagtttagtatctggtcacgggagagaaaataaaagctgcagaggttgggggtggggtcagggattctagggatggggcagagtggcagcatcctttgtacctacaggtggatcccacaactcatttgacctttaaccttcacctgtccaagaaagagagagaagccagagatagcctgatcctgcccttccagttcagttctgaaaagtaaggttgggacctgggtacgtggatccctgagtagatcccagcatctgggccatggagaggttggggcaacaggttattgattaacctgactttatagggactgaagtccacctccagagacaagtccaagttcttgatccacccattccccctataatggcagaggacctttatgtctcttttctctcccttatacccttgggtcacagctccagttgtccccagagcaccctgggcctgggctgagccagaccagacccttgggaggtggccctatccctaggcagtggtgctaggaggacagaaggctatatgggcgtggcagaggctggttaacaagggcttagtacacgcttgctgttctgtgcccagtatgtgggcggatgacgcaagactacaagatccttgccctcaagctgctaggaacttacggttttattaggagagcagtacaagggtatctatcccagtaccaaatggtgcttcagctctaacatggaggtcagagaaagggacttggaccaataaaatgacatggaggcctaacaggttgcctgaatgagagtcacagtcacctggaagaaagtatccagacccaacctgttagctaccctcaccagcaccaaatcttcccttctcagacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaagaa

SEQ ID NO: 129563 - DNA, 864 bp, Homo sapiens
  Payload ID: 5334
  Gene Symbol: ELP5
  Gene Name: elongator acetyltransferase complex subunit 5
  ENST ID: ENST00000573699
  CDS Start-End: 236-864
cagagaggggcacggagcgggcggctcagaaagccacccctggcgagggtaaagcccagcggaacggggagctgggggacaggcgtgggcagcccgcgggggcccacatgggctgggagtggcaccgacggcttcggggaggttgcgggccgagacagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgccc

SEQ ID NO: 129564 - DNA, 827 bp, Homo sapiens
  Payload ID: 5334
  Gene Symbol: ELP5
  Gene Name: elongator acetyltransferase complex subunit 5
  ENST ID: ENST00000573513
  CDS Start-End: 137-827
cggtggtgacgtgtattcgcttcaccgggactaagttcctcctgcgcggtctatggcggactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggc

SEQ ID NO: 129565 - DNA, 1083 bp, Homo sapiens
  Payload ID: 5334
  Gene Symbol: ELP5
  Gene Name: elongator acetyltransferase complex subunit 5
  ENST ID: ENST00000570322
  CDS Start-End: 1-737
gagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccgacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaagaa

SEQ ID NO: 129566 - DNA, 671 bp, Homo sapiens
  Payload ID: 5334
  Gene Symbol: ELP5
  Gene Name: elongator acetyltransferase complex subunit 5
  Uniprot ID: Q8TE02
  ENST ID: ENST00000574255
  CDS Start-End: 105-644
aagttcctcctgcgcggtctatggcggactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgagacccctccttcattgtttcccctcatacatctccctctgccaaggagtgtgccccttttcctttctaccctagaataaacatctgggttctccagtcagaccttt

SEQ ID NO: 129567 - DNA, 510 bp, Homo sapiens
  Payload ID: 5334
  Gene Symbol: ELP5
  Gene Name: elongator acetyltransferase complex subunit 5
  ENST ID: ENST00000574841
  CDS Start-End: 381-510
gcggggggtgcggttcgggcctggctgaggggacggaagtgggcaggaagggccaggggtcacaggctaggtgtggaaatcgcgacgggttcgcgaaggcggtaatcccagcgctctcataccctttatccgtccctcgctctgcagattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctg

SEQ ID NO: 129568 - DNA, 1401 bp, Homo sapiens
  Payload ID: 5335
  Gene Symbol: ELP6
  Gene Name: elongator acetyltransferase complex subunit 6
  Uniprot ID: Q0PNE2
  ENST ID: ENST00000296149
  CDS Start-End: 172-972
ggtcccatcgaggcacccgcctcattggctgtggctggctcgcaaaagtggcattgcgcatgcgcgcttccttgcgcgagccgggctgtcgggtgtgttttgctctccagcctccgtcgtctctgcagcactccgggttctcctccagagcgctagtcccaggagctcggaatgttcgtggaacttaataacctgcttaacaccacccccgacagggcggagcaggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactgga

SEQ ID NO: 129569 - DNA, 1277 bp, Homo sapiens
  Payload ID: 5335
  Gene Symbol: ELP6
  Gene Name: elongator acetyltransferase complex subunit 6
  ENST ID: ENST00000442215
  CDS Start-End: 120-302
attgcgcatgcgcgcttccttgcgcgagccgggctgtcgggtgtgttttgctctccagcctccgtcgtctctgcagcactccgggttctcctccagagcgctagtcccaggagctcggaatgttcgtggaacttaataacctgcttaacaccacccccgacagggcggagcaggggaaactgactctactctgtgatgccaagacagatgggagtttccttgtacaccactttctctccttctatctcaaagggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactgg

SEQ ID NO: 129570 - DNA, 1011 bp, Homo sapiens
  Payload ID: 5335
  Gene Symbol: ELP6
  Gene Name: elongator acetyltransferase complex subunit 6
  ENST ID: ENST00000445044
  CDS Start-End: 236-442
ggggattggactggaggcttgggcccgccgaaagtgggcttctgggccatctcgcatattctcaacggctgggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagacatttaagaaaaaatttttcccctggtttggtattcaacatcacaggcctgagactggttttcctgcttttcctcctttctgaacattggccacaaacatagctctgtgaagactccccgcttggctgctgttcttcgtccactacaaagtggtccacacaggaacttcccccactgccttatctctcagacacacacacccttatgcagtgggtgtgaggccatgtttcctgaccctgtgtgtgacttcacacacatcccttagcatctctgacttggggtttcctcatttgaaggcaggggctggttatacctcatcccaagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggc

SEQ ID NO: 129571 - DNA, 594 bp, Homo sapiens
  Payload ID: 5335
  Gene Symbol: ELP6
  Gene Name: elongator acetyltransferase complex subunit 6
  ENST ID: ENST00000425291
  CDS Start-End: 255-594
taaggtgtggacacaattgactagatttctgcactaagctgacctctttccagggagtctaacctttttgtgttccttgtaacttttaggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaaggtactcatggaactgccttctctgcgcccacctg

SEQ ID NO: 129572 - DNA, 880 bp, Homo sapiens
  Payload ID: 5335
  Gene Symbol: ELP6
  Gene Name: elongator acetyltransferase complex subunit 6
  ENST ID: ENST00000439305
  CDS Start-End: 259-840
tgtagtccgcagaggatcgacccggggattggactggaggcttgggcccgccgaaagtgggcttctgggccatctcgcatattctcaacggctgggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgttttt

SEQ ID NO: 129573 - DNA, 557 bp, Homo sapiens
  Payload ID: 5335
  Gene Symbol: ELP6
  Gene Name: elongator acetyltransferase complex subunit 6
  ENST ID: ENST00000414236
  CDS Start-End: 318-557
atctcgcatattctcaacggctgtgcgtgtccttaaaagtccctgggaagcggccgggcgcggtggctcacccctgtaatcccagcagtttgggaggccgaggcgggtgcatcatctaaggtcaagagttcgagacaagtctggccaagatggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggc

SEQ ID NO: 129574 - DNA, 1008 bp, Homo sapiens
  Payload ID: 5335
  Gene Symbol: ELP6
  Gene Name: elongator acetyltransferase complex subunit 6
  ENST ID: ENST00000444760
  CDS Start-End: 556-1008
actggaggcttgggcccgccgaaagtgggcttctgggccatctcgcatattctcaacggctgtgcgtgtccttaaaagtccctgggaagcggccgggcgcggtggctcacccctgtaatcccagcagtttgggaggccgaggcgggtgcatcatctaaggtcaagagttcgagacaagtctggccaagatggtgaaacccccgtctctacgaaaaatacaaaaattagccgggcgtggtggctcatgcctgtaatctcagctactcgggaggctgagacaggagaattgcttgaacccgggaggcggaggttgcagtgacccgagatctcgccaccgcactccagcctgggcgacagagcgggactccacctcaaaaaaaaaaaaaaaaagggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcag

SEQ ID NO: 129575 - DNA, 579 bp, Homo sapiens
  Payload ID: 5335
  Gene Symbol: ELP6
  Gene Name: elongator acetyltransferase complex subunit 6
  ENST ID: ENST00000449409
  CDS Start-End: 283-579
tcgcatattctcaacggctgtgcgtgtccttaaaagtccctgggaagcggccgggcgcggtggctcacccctgtaatcccagcagtttgggaggccgaggcgggtgcatcatctaaggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgg

SEQ ID NO: 129576 - DNA, 894 bp, Homo sapiens
  Payload ID: 5335
  Gene Symbol: ELP6
  Gene Name: elongator acetyltransferase complex subunit 6
  ENST ID: ENST00000446787
  CDS Start-End: 190-771
tctactctgtgatgccaagacagatgggagtttccttgtacaccactttctctccttctatctcaaagctaattgtaaagtctgctttgtggcactcatccagtccttcagccactacagtatcgtgggacagaagctggtaaatattttggagctccatgatgaggtccctgaggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactg

SEQ ID NO: 129577 - DNA, 705 bp, Homo sapiens
  Payload ID: 5335
  Gene Symbol: ELP6
  Gene Name: elongator acetyltransferase complex subunit 6
  ENST ID: ENST00000412761
  CDS Start-End: 233-705
catcatttcagggtaccttagcatgtatgtcattaaaaaaataaactcttcaggtggagaaattaaggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcaggtatgcaggggcctcctggg

SEQ ID NO: 129578 - DNA, 1477 bp, Homo sapiens
  Payload ID: 5336
  Gene Symbol: ELOVL1
  Gene Name: ELOVL fatty acid elongase 1
  Uniprot ID: Q9BW60
  ENST ID: ENST00000372458
  CDS Start-End: 119-958
gcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccacgga

SEQ ID NO: 129579 - DNA, 1451 bp, Homo sapiens
  Payload ID: 5336
  Gene Symbol: ELOVL1
  Gene Name: ELOVL fatty acid elongase 1
  Uniprot ID: Q9BW60
  ENST ID: ENST00000413844
  CDS Start-End: 175-933
aatcagcgggcgccccccgcgcggcccgcccctccccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccacgg

SEQ ID NO: 129580 - DNA, 1625 bp, Homo sapiens
  Payload ID: 5336
  Gene Symbol: ELOVL1
  Gene Name: ELOVL fatty acid elongase 1
  Uniprot ID: Q9BW60
  ENST ID: ENST00000621943
  CDS Start-End: 268-1107
ccccacacccccgtctctggcccccatttgcctacacccgggccttcctccaccacccctgcatttacctctctccctcctcctctcccctccctccccccgctaccctaactttgccaggcaccttttcccttccatccatcttaaaggaaggaagggacgggctgagttccccgacgagagacacacccagattttcctgcagcttggggagaggtcctcccaggagccttggtccctcctggcctgccggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccacgg

SEQ ID NO: 129581 - DNA, 3997 bp, Homo sapiens
  Payload ID: 5337
  Gene Symbol: ELOVL2
  Gene Name: ELOVL fatty acid elongase 2
  Uniprot ID: Q9NXB9
  ENST ID: ENST00000354666
  CDS Start-End: 85-975
gatagcgccgggcagagggacccggctaccctggacagcgcatcgccgcccgcccgggtcgccgcgccacagccgctgcggatcatggaacatctaaaggcctttgatgatgaaatcaatgcttttttggacaatatgtttggaccgcgagattctcgagtcagagggtggttcatgttggactcttaccttcctaccttttttcttactgtcatgtatctgctctcaatatggctgggtaacaagtatatgaagaacagacctgctctttctctcaggggtatcctcaccttgtataatcttggaatcacacttctctccgcgtacatgctggcagagctcattctctccacttgggaaggaggctacaacttacagtgtcaagatcttaccagcgcaggggaagctgacatccgggtagccaaggtgctttggtggtactatttctccaaatcagtagagttcctggacacaattttcttcgttttgcggaaaaaaacgagtcagattacttttcttcatgtatatcatcatgcttctatgtttaacatctggtggtgtgtcttgaactggataccttgtggacaaagtttctttggaccaacactgaacagttttatccacattcttatgtactcctactatggactttctgtgtttccatctatgcacaagtatctttggtggaagaaatatctcacacaggctcagctggtgcagttcgtgctcaccatcacgcacaccatgagcgccgtcgtgaaaccgtgtggcttccccttcggttgtctcatcttccagtcatcttatatgctaacgttagtcatcctcttcttaaatttttacgttcagacataccgaaaaaagccaatgaagaaagatatgcaagagccacctgcagggaaagaagtgaagaatggtttttccaaagcctacttcactgcagcaaatggagtgatgaacaagaaagcacaataaaaatgagtaacagaaaaagcacatatactagcctaacagattggcttgttttaaagcaaagactgaattgaaggttacatgttttaggataaactaatttcttttgagttcataaatcatttgtacccagaatgtattaatatattgctattaggttaatctgttaactgaatgctttgatcagcattgaggtgatgctcacctccgaggacctcagaactggtgcagcttctctctccctccctcccacagactgaacctttcgccagaagctgtccttataacgccttatacgcatacacagccaggaaacgtggagcattgtttctcacagagagtctccaaataaaaagggttttgttcagattaaaatgtttacaacaaaatgttaattatattctaaatacagggtatgttctaatctatattaagcaataatgccagtgcataatcattccatttgttcctttagcaatcaaccccagaaaatattaaaatgggatcatacacagaagatagaaaaatctagcaaaacttctctttctgtaagccagagtcttgtctatcagattcccacaaccactcctgattctaaatttagtgatatggtaatgaaattggtatttattttaaatattagttattctaaggagaaaaaaatgcttctgcaagattttcataattcaggggctgtggataggattgttcctctgtttccctaatcattcatctgttcatgtctccctcttgtgccagtcagcctaggttatacagatgccatgctccacaccacgagcagtgtacaaatctggctgcccgtttactttctgagcaagcactggagtccactccgacctttttctttgaacatgcatgctgctggaatatgtataaatcagaactagcagaagtagcagagtgatgggagcaaaataggcactgaattcgtcaactcttttttgtgagcctacttgtgaatattacctcagatacctgttgtcactcttcacaggttatttaagtttttgaagctgggaggaaaaagatggagtagcttggaaagattccagcactgagccgtgggccggtcatgagccacgataaaaaatgccagtttggcaaactcagcactcctgttccctgctcaggtatatgcgatctctaccgagaagcaagcacaaaagtagacaaaagtattaatgagtatttcctttctccataagtgcaggactgttactcactactaaactctaccaagaatggaaacaaagaatattttctgaagatttttttgaagattaatttataccctataaaataaaacttgttagcttcgatgaagtcacttcatcttctctcctgccttatttttttaaataagtttttaggtcctgacactgacatcaaatacatgcacaccagaaaggcatttccaccaccgtccccactcattagcgtccagagtgcctttctctctcggctttttttcccccctgagctctagttttaaactttctcctgttaaaaaaattgtacttttatttcatgtaaactgcccctctgaggatttgggcatattttttggaaggtgcctaatgcttaggatagtctctagggtgatgcactgcacctgcttccttcccttcagtgcggccgacccatttctgttgaacagatgtctcctgtgtgatgcccctgactcttacatttatctttctaaatcattttctgaagctgacttgctctagggtgcttcatcaccacttccatcttgcatcaccttataactgttctgtcttgttctctcccagcaatttattttaaaacaagggctagcttcaagcatgactgttaatggctcctctgtgacaaaacacaagttggaccaaggagaaagccctttggagaaactggaccctagttcagtttagatctcaaatataggctgaaatctcttaccaaagtgcgttccagataaaaatgagacttagaagacagactggtctaatatgctcactggtcatcacattcagcttattcttacgtgccagtgaggccctaaggtctcagtgcatagcatacctgccactctggatgttttcctgggcttcatatctgtatggcaaggagggagctgtccttcagcagacaaagtcaagcagctttaagtacaaggcagcttgaaacctctctgatgaaagtgaaaaatgtgggtagcttatactttcaaactaatgccagtgactagagagaggtttcattcatgatgtgtatttccaatttggtcttcaattcaagagatgcttcataaaacacttatagccttaaaccattcaagggctaattaaaaaaatagttatgaaatcttagccacaaaaaataaatcaggtaaacattttaacctgtcgttaagtgttgtaacttcaaaaaaccaaaatgcttattttaatgtgatttttctaaaactattgaaaaattaatatttctataatctattaaaaaaaatggagaatgttttctctcaaatttcctctgacccatgggaatgaaaatacttaaatactgtaaagcatatctattaataattcccccaattttttaaactaacaaaatggaatgttaactgaatggaattaaacatagcaattgtcaagccatcaaaattatatatcgaaccacttaggcatgttacggggtaaagtcctcacccctgcatttgagaaatattttattatttttattttaaggcaaaacagtgtttactgtgatgggcagaacagccttttgtatctaggagtccatttgagttctttccaatatttccatatcgttcataaatgtgtctgggggcttccttgtttggaaaatatggatatcgctttgttttcctttgaaagtaattatatcttaagaacatagtatcatgaatggagtagacagggaggctgcagaagccatttctctttgtagataaaaagcattatctatgattgttgtataataaattgatttttacattaaa

SEQ ID NO: 129582 - DNA, 1371 bp, Homo sapiens
  Payload ID: 5338
  Gene Symbol: ELOVL3
  Gene Name: ELOVL fatty acid elongase 3
  Uniprot ID: Q9HB03
  ENST ID: ENST00000370005
  CDS Start-End: 222-1034
ggcagctttgcaagtccgcgttatatatcgcagtggctgcgcccgggatagctggctgcgccgccgcgcacatgcctaggttcgacgccctcctccctttgcccaggagttccttctgtcccggctctgttccgtctcgccccgaggttcacgccatcctcggagccccagcctttcacccagcgcctccaagctttggaccttgacttctgcaaaactagatggtcacagccatgaatgtctcacatgaagtaaatcagctgttccagccctataacttcgagctgtccaaggacatgaggccctttttcgaggagtattgggcaacctcattccccatagccctgatctacctggttctcatcgctgtggggcagaactacatgaaggaacgcaagggcttcaacctgcaagggcctctcatcctctggtccttctgccttgcaatcttcagtatcctgggggcagtgaggatgtggggcattatggggactgtgctacttaccgggggcctaaagcaaaccgtgtgcttcatcaacttcatcgataattccacagtcaaattctggtcctgggtctttcttctcagcaaggtcatagaactcggagacacagccttcatcatcctgcgtaagcggccactcatctttattcactggtaccaccacagcacagtgctcgtgtacacaagctttggatacaagaacaaagtgcctgcaggaggctggttcgtcaccatgaactttggtgttcatgccatcatgtacacctactacactctgaaggctgccaacgtgaagccccccaagatgctgcccatgctcatcaccagcctgcagatcttgcagatgtttgtaggagccatcgtcagcatcctcacgtacatctggaggcaggatcagggatgccacaccacgatggaacacttattctggtccttcatcttgtatatgacctatttcatcctctttgcccacttcttctgccagacctacatcaggcccaaggtcaaagccaagaccaagagccagtgaaggtttggagagaacaatgaagctccaggctctctcttctccagggcaccaagaggctgggcttagttttgggagaatgattaggttgccttacctgcatggtttccccagaggatgtgtgccccaaggtggctggaatttttgacagacaagaagggtgaccttgggatgggggtgtggtctgttactttaatgtttctgtttttaatgtgaaggccaagcaggccctgggatgggagtggggcggaggagggtcctaagagctgattatttaatttctatccagaaatctttcttcttcttgctctgtttttttaaattaaagatttcaacaaaa

SEQ ID NO: 129583 - DNA, 3042 bp, Homo sapiens
  Payload ID: 5339
  Gene Symbol: ELOVL4
  Gene Name: ELOVL fatty acid elongase 4
  Uniprot ID: Q9GZR5
  ENST ID: ENST00000369816
  CDS Start-End: 302-1246
agattggaggggcggctgcgcgaggctgcagactggtgcagcgcactgtgctggcggctgggcctcctccacctcctcgtctttctcccgggaaccttgacgacgccttccgcttggccctgccttctgccgcatccccgccgccgcggcgccttgaggagcaggagaagacgcagccgggccgccgccgttagaggggttcccggccgccgctcgccccgtcggccgccaccgcctccggggtcagccctctctctgggtctccgctttctcctgccgccagcgcccgctcatcgccgcgatggggctcctggactcggagccgggtagtgtcctaaacgtagtgtccacggcactcaacgacacggtagagttctaccgctggacctggtccatcgcagataagcgtgtggaaaattggcctctgatgcagtctccttggcctacactaagtataagcactctttatctcctgtttgtgtggctgggtccaaaatggatgaaggaccgagaaccttttcagatgcgtctagtgctcattatctataattttgggatggttttgcttaacctctttatcttcagagagttattcatgggatcatataatgcgggatatagctatatttgccagagtgtggattattctaataatgttcatgaagtcaggatagctgctgctctgtggtggtactttgtatctaaaggagttgagtatttggacacagtgttttttattctgagaaagaaaaacaaccaagtttctttccttcatgtgtatcatcactgtacgatgtttaccttgtggtggattggaattaagtgggttgcaggaggacaagcattttttggagcccagttgaattcctttatccatgtgattatgtactcatactatgggttaactgcatttggcccatggattcagaaatatctttggtggaaacgatacctgactatgttgcaactgattcaattccatgtgaccattgggcacacggcactgtctctttacactgactgccccttccccaaatggatgcactgggctctaattgcctatgcaatcagcttcatatttctctttcttaacttctacattcggacatacaaagagcctaagaaaccaaaagctggaaaaacagccatgaatggtatttcagcaaatggtgtgagcaaatcagaaaaacaactcatgatagaaaatggaaaaaagcagaaaaatggaaaagcaaaaggagattaaattgaactgggccttaactgttgttgacagtgaggaaaaactcccatatcatataaaatttcagggaaaacagaagcaaaggagagcttgggggtggggagaaaagacaaatgtgctctatgtcctagtaactcttagactgagtaaagtgttaataccatacccagatgttttatttatgaagtttttattttaaacattttttttaaaaattagccttgatattctccagaccaaagcaatcattaagtgactttggggattctccccctgttcacatccagttgtctaaaggatgagatttttcatgtatcttatagtcactcattcttcggtctgaattttagacgatcacagaaacggtctttatgaattattttgataaattactaattatcttatctactgactgaaatcagtggtgttacattttcttgtccaaagctgaaaatgtgtatacacttaaacttgcacatttgaattcatttgctgaccggaatggtcaaatctctccacctctagtcagagtataattttggttgtaattaaatttttaaaatctgctgatctctgtagaatcttagaggcttgatgatgatggtgttggtgaaaataagaaagaattgcagtaaagtcttgtctggtgacccagagatcaccatgacttgaggcacaaatcactgtggggaaacaattttttgtgatgaaaaggcagcatttgaatactcctgttagtagcagaaatatattatgaaaattaagattattgtctgattgaaacatgaaacaactcatgtctttattagtaacatcataagatagttacatttatgtgctgttagaatatgttgatttttatcaggctttccttgttttgatttatggctgttcctgatttttcatatgtggaaatatacctacctcttccgttggaaagaacatttaaaattaaataaattttaattaaaaaatcaaggagtcttctaatgtaaattttaatgttaactttcaaatccactagtattttttttgcttttatgacaaatagcatacaccaaacatttctgtgaaactatccttctctttcaatgtgtttaattttggagtaacgttttccttgtgactaagttgcaagatcttatttattaactaggtatgaagtataaacccattttggtgcaatattcttgactccttggtgctaaagattgttaaattcaatgcttgatgttacaaggtgttgttaaaacacaaaatgaataaaagtgagagtagtcagaactataacattcaatttgctatttacaaatgaagtatttcatgtaatataagtgaacaactggaaataaagtaggaaagaatttgtatcatgttttactacataggttaattttttaagggatgttgcaaagggattactagagaaagacaaaatgtgaccaaaaaaaagcatgaatatttcttaagtatctcaacaacatgtcaaagctgcatgtgtaggatgtatgctgtttgtacaaactatttcagaatattttgtaagctataacatatttattgtgcattaaaattaaatactttttccccaaaggcatgcagtcatgagaattacagaaaatttgcaacatataaagtagtttgatctaagaggattcaacacctttgttttgttgctcagtgtgtaatgactgagatttgtaaatctttgtgaacattctgtactggttcccaagagctattcattccctgctacctgatttcagcacaataaatatacttctgctgtgggaaaaata

SEQ ID NO: 129584 - DNA, 2827 bp, Homo sapiens
  Payload ID: 5340
  Gene Symbol: ELOVL5
  Gene Name: ELOVL fatty acid elongase 5
  Uniprot ID: Q9NYP7
  ENST ID: ENST00000304434
  CDS Start-End: 200-1099
gcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgt

SEQ ID NO: 129585 - DNA, 580 bp, Homo sapiens
  Payload ID: 5340
  Gene Symbol: ELOVL5
  Gene Name: ELOVL fatty acid elongase 5
  Uniprot ID: Q9NYP7
  ENST ID: ENST00000370913
  CDS Start-End: 119-385
ccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgaggtatcagcagctctgtcctcagaatgggtcccccacttcacacagttgtaggatggctacagcagctccaagcagcacattcagaggaagaagaaaaaatgtttcatttgtgtggttttaagcataaagaagttgtttcccagagctctttgccagctgtcatccctcaaaactcactggccacaattgcttcacatgcccctgcctgaaccagccaccagagggggttaggaccaccacagattgactagatcctaaggattctctacctggggctggagttcgggtcaggtgcccgggaagcactgtgcggtgtgggaggatgaatatgtgccaatttggaaagatgagtatttgtgggaaaatgaataaagcaaagtgtaaatcagaggtttaagttaaaa

SEQ ID NO: 129586 - DNA, 3081 bp, Homo sapiens
  Payload ID: 5340
  Gene Symbol: ELOVL5
  Gene Name: ELOVL fatty acid elongase 5
  Uniprot ID: Q9NYP7
  ENST ID: ENST00000370918
  CDS Start-End: 372-1352
aaaaaaatttcccagagacacgtggaaccgaggggccaaccccggcctaggctctccaccgcatcggattctggaatttacgatcacgaaagttctattgtcccgcgattggctcccgggccgcatgacatcatagcgcttgattcatccttcgggtcccgattggctggccgcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagtccaaaagggagcaaccccgtcgatctgcctgtgcctcacgaactgatccttcgactcagcagcagctgccagaaaacaggttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgtg

SEQ ID NO: 129587 - DNA, 2875 bp, Homo sapiens
  Payload ID: 5340
  Gene Symbol: ELOVL5
  Gene Name: ELOVL fatty acid elongase 5
  ENST ID: ENST00000542638
  CDS Start-End: 372-1160
aaaaaaatttcccagagacacgtggaaccgaggggccaaccccggcctaggctctccaccgcatcggattctggaatttacgatcacgaaagttctattgtcccgcgattggctcccgggccgcatgacatcatagcgcttgattcatccttcgggtcccgattggctggccgcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgtg

SEQ ID NO: 129588 - DNA, 3090 bp, Homo sapiens
  Payload ID: 5341
  Gene Symbol: ELOVL6
  Gene Name: ELOVL fatty acid elongase 6
  Uniprot ID: Q9H5J4
  ENST ID: ENST00000302274
  CDS Start-End: 342-1139
cacgagggggaggagatttccctgtagacgagtaaaaagggtgatggacaaacgtgcgggcactaagaccgcaaggcattcatttcctcctacggtggatgcggacgccgggaggaggagagccccagagagaggagctgggagcggaggcgcaggcaatgctcagccctggatgtagctgagaggctgggagaagagacgaccgctggagaccgagcggcgtggggaagacctaggggggtgggtgggggaagcagacaggagaacactcgaaatcaagcgctttacagattattttattttgtatagagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcagtatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactaggagatacaatattcattattctgaggaagcagaagctgatcttcctgcactggtatcaccacatcactgtgctcctgtactcttggtactcctacaaagacatggttgccgggggaggttggttcatgactatgaactatggcgtgcacgccgtgatgtactcttactatgccttgcgggcggcaggtttccgagtctcccggaagtttgccatgttcatcaccttgtcccagatcactcagatgctgatgggctgtgtggttaactacctggtcttctgctggatgcagcatgaccagtgtcactctcactttcagaacatcttctggtcctcactcatgtacctcagctaccttgtgctcttctgccatttcttctttgaggcctacatcggcaaaatgaggaaaacaacgaaagctgaatagtgttggaactgaggaggaagccatagctcagggtcatcaagaaaaataatagacaaaagaaaatggcacaaggaatcacacgtggtgcagctaaaacaaaacaaaacatgagcaaacacaaaacccaaggcagcttagggataattaggttgatttaacccagtaagtttatgatccttttagggtgaggactcactgagtgcacctccatctccaagcactgctgctggaagaccccattccctctttatctatcaactctaggacaagggagaacaaaagcaagccagaagcagaggagactaatcaaaggcaaacaaaggctattaacacataggaaaaaatgtatttactaagtgtcacatttctctaagatgaaagatttttactctagaaactgtgcgagcacaacacacacaatcctttctaactttatggacactaaactggagccaatagaaaagacaaaaatgaaagagacacagggtgtatatctagaacgataatgcttttgcagaaactaaagcctttttaagaaatgccagctgctgtagaccccatgagaaaagatgtcttaatcatccttatgaaaacagatgtaaacaactatatttcaactaacttcatcttcactgcatagcctcaggctagtgagtttgccaaaaccaaagggggtgaatacttccccaagattcttcctgggaggatggaaacagtgcagcccaggtcccatgggggcagctccatcccagagcatttctgatagttgaactgtaatttctactcttaagtgagatatgaagcattatccttttgttcagttgccccgggcttttgaacagaagagtaaatacagaattgaaaaagataaacactcaaccaaacaatgtgaaaacgggttctgtagtatttgtaaaaaggcccggcccaggaccactgtgagctggaaaagggagaaaggcagtgggaaaagaggtgagccgaagatcaattcgacagacagatggtgtgtatgcccctccctgtttgacttcacacacactcataactttccaaatgaaaccccacagtatagcgcatattttcgatatttttgtgaattccaaaaggaaatcacagggctgttcgaaatattgggggaacactgtgtttctgcatcatctgcatttgctccccaagcaatgtagaggtgtttaaagggccctctgctggctgagtggcaatactacaacaaacttcaaggcaagtttggctgaaaacagttgacaacaaagggcccccatacacttatccctcaaattttaagtgatatgaaatacttgtcatgtctttggccaaatcagaagatattcatcctgcttcaagtcagcttcagaaatgttttaaaagggactttagctctggaactcaaaatcaatttattaagagccatattctttaaaaaaaaaaagctggataatattctctgtaatatttcagtcctttacaagccaaatacatgtgtcaatgtttctagtatttcaaagaagcaattatgtaaagttgttcaatgtgacataatagtattataattggttaagtagcttaatgattaggcaaactagatgaaaagattaggggcttccacactgcatagattacacgcacatagccacgcatacacacacagacacacagatgtggggtacactgaacttcaaagcccaaatgaatagaaacacattttctggctagcagaaaaaaacaaaacaaaactgttgtttctctttcttgctttgagagtgtacagtaaaagggattttttcgaattatttttatattattttagctttaattgtgctgtcgttcatgaaacagagctgctctgcttttctgtcagagatggcaagggctttttcagcatctcgtttatgtgtggaatttaaaaagaataaagttttattccattctg

SEQ ID NO: 129589 - DNA, 6454 bp, Homo sapiens
  Payload ID: 5341
  Gene Symbol: ELOVL6
  Gene Name: ELOVL fatty acid elongase 6
  Uniprot ID: Q9H5J4
  ENST ID: ENST00000394607
  CDS Start-End: 165-962
gtagacgagtaaaaagggtgatggacaaacgtgcgggcactaagaccgcaaggcattcatttcctcctacggtggatgcggacgccgggaggaggagagccccagagagaggagctgggagcggaggcgcagagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcagtatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactaggagatacaatattcattattctgaggaagcagaagctgatcttcctgcactggtatcaccacatcactgtgctcctgtactcttggtactcctacaaagacatggttgccgggggaggttggttcatgactatgaactatggcgtgcacgccgtgatgtactcttactatgccttgcgggcggcaggtttccgagtctcccggaagtttgccatgttcatcaccttgtcccagatcactcagatgctgatgggctgtgtggttaactacctggtcttctgctggatgcagcatgaccagtgtcactctcactttcagaacatcttctggtcctcactcatgtacctcagctaccttgtgctcttctgccatttcttctttgaggcctacatcggcaaaatgaggaaaacaacgaaagctgaatagtgttggaactgaggaggaagccatagctcagggtcatcaagaaaaataatagacaaaagaaaatggcacaaggaatcacacgtggtgcagctaaaacaaaacaaaacatgagcaaacacaaaacccaaggcagcttagggataattaggttgatttaacccagtaagtttatgatccttttagggtgaggactcactgagtgcacctccatctccaagcactgctgctggaagaccccattccctctttatctatcaactctaggacaagggagaacaaaagcaagccagaagcagaggagactaatcaaaggcaaacaaaggctattaacacataggaaaaaatgtatttactaagtgtcacatttctctaagatgaaagatttttactctagaaactgtgcgagcacaacacacacaatcctttctaactttatggacactaaactggagccaatagaaaagacaaaaatgaaagagacacagggtgtatatctagaacgataatgcttttgcagaaactaaagcctttttaagaaatgccagctgctgtagaccccatgagaaaagatgtcttaatcatccttatgaaaacagatgtaaacaactatatttcaactaacttcatcttcactgcatagcctcaggctagtgagtttgccaaaaccaaagggggtgaatacttccccaagattcttcctgggaggatggaaacagtgcagcccaggtcccatgggggcagctccatcccagagcatttctgatagttgaactgtaatttctactcttaagtgagatatgaagcattatccttttgttcagttgccccgggcttttgaacagaagagtaaatacagaattgaaaaagataaacactcaaccaaacaatgtgaaaacgggttctgtagtatttgtaaaaaggcccggcccaggaccactgtgagctggaaaagggagaaaggcagtgggaaaagaggtgagccgaagatcaattcgacagacagatggtgtgtatgcccctccctgtttgacttcacacacactcataactttccaaatgaaaccccacagtatagcgcatattttcgatatttttgtgaattccaaaaggaaatcacagggctgttcgaaatattgggggaacactgtgtttctgcatcatctgcatttgctccccaagcaatgtagaggtgtttaaagggccctctgctggctgagtggcaatactacaacaaacttcaaggcaagtttggctgaaaacagttgacaacaaagggcccccatacacttatccctcaaattttaagtgatatgaaatacttgtcatgtctttggccaaatcagaagatattcatcctgcttcaagtcagcttcagaaatgttttaaaagggactttagctctggaactcaaaatcaatttattaagagccatattctttaaaaaaaaaaagctggataatattctctgtaatatttcagtcctttacaagccaaatacatgtgtcaatgtttctagtatttcaaagaagcaattatgtaaagttgttcaatgtgacataatagtattataattggttaagtagcttaatgattaggcaaactagatgaaaagattaggggcttccacactgcatagattacacgcacatagccacgcatacacacacagacacacagatgtggggtacactgaacttcaaagcccaaatgaatagaaacacattttctggctagcagaaaaaaacaaaacaaaactgttgtttctctttcttgctttgagagtgtacagtaaaagggattttttcgaattatttttatattattttagctttaattgtgctgtcgttcatgaaacagagctgctctgcttttctgtcagagatggcaagggctttttcagcatctcgtttatgtgtggaatttaaaaagaataaagttttattccattctgtgtgaatggtttgagcagtgaacaaagaatccatgcaaaccaagtcatgactggaagaaatggggagtgggggacagtgcaggggaggaaagctgttacatctatgttaaatgattgtgagcagtctataatgtcttgatgttggttcataggtgagacacaactgatggaggaatgtattataaattatgcaaaatctgacatgagctgaaaagacaggtccttttataagagctaatagatgcttaggatgcaaatgttattttgagcttcgcaaatacatgataccgtgcaataagccttttttccttataacagaaaatgagaataattaaaatgaggagaaggccacataacagttgacttgaatttaattgaaggacccattggaggctcatctggttgatttaattatttaattgagtgatttattgcagatctcttaatgcaggttagaaacggaagtgagcataaaccttaaaaagactctaaatgatgcttccaaagcactttcattttggtattaggttcatgtttgtttgtctttacttgtaaaataatttggaatttttgtttacagggtgaatgtcttaatagttttaaaattagctaaatatatctaaaggcatttccaatgtttatcatgggaggaaaaaagccacattttttttaaaacaaaacaaaacaaaacaaaattttggtaatataggttcaatacactgtttttaacatctcagcttagccgctttaatcatatcaagatatgaggctggatcactggcccatgacaaatctgaaacctaccagagaattgactgctgcatagataatcctgctgccagttaacattccagaaaaacttgggcaggcaagtttttatagctgccccactatgctgcaatagagtatctttctattgaagattttccactgcatcccgatcctactatggtgaaagcattgttcttgggctaaaaaaaaatcctttatttcatacacacatgatttcatacactaggtctgagcatcaagccaagtccatgagtttgcaatgaagttctagtgagaaatgctctattcataaagcagggggtttacgtggaccttctagtgttgcttatgggaaaagagtaactaccatattacatctaacgcaaggccaaagtaccaaattaaaaccatggattgaggtggttattcgaagtcacttactcccatccttctaattatgctccactacaaaagtaaggggagaagagggaatactttacatgtacattgctagagggaaaagaaaggcttgattatatcccctcgcttctccacctctctgctcatgtaaagaaactgatgagaaaagagactaatatgtctagactgagttagaaacttcatatgagtgggttttgtagaattgatgggaaagacagtgggaacctagaagaacagaaagagacccacagaatgtctttctttttttttttttttttttttttgaggtggattcttgctgttgttgcccaggctggagtgcagtggcgcgatctagactcactgcaacctccgcctcccaggttccagcaattctcctgcctcagcctcccaaatagctgaggttacaggcgcccgccaccacacccagctaatttttgtatttttagtagagacagggtttcaccatgttggccaggctggtctcgagctcctgacctcaggggatccacccgccttggtctcccaaagtgctgggattataggcgtgagccaccgtgcctggcccagaatgtttttttaaatcagatgtagcatcttcataaggtaaagcctgtcacatcagagtaacaaagctcctggagtacagtgatgctagagtagaatgttccagaagtctggccatagccccagcttctgaattacctgggagagacaagatgctcaggttactattttttctttattctgatagtacagcctctactcagagaccacggtgtgtgtcacacaaccgaggcagctagggcatattctgagggcttttttttttttttggtttccttaatgattctttaacagagtaactggattggccaaggtctgattcaagaggctgtgaggagagtagagaacaaatagactttgcctctcagagttcagagctttaagttgtataagcatggtccatgtccacctcttgtagacacttattccttaaaagtttccatcatgaaaaataatatcatgtcaaaattttataagcacccagaatgtcccagtagtcaaatgtagtgtctttctccagtctctgttttcgataataaataccttgctctcaatttaggatgatcgtaaagcctatgttcatgctgtgagtcattgtctcccacagcttttgaaacatcgttctttgtcttttctatacaacacctgattctttgtgcctcagactcattgctatcaggaagagactttgccaagatccaccaccacatttggccagtagtgtatacacattaaagtgagagctgatgaaatcacaatgctctattttgttccgacaatcagtatgaaggggtaggtcccagtttgccaatgagcaacagcctctgtatgctggtgtccaagacttacacaaaacaagtgtcagtgcagtcacagcattttcttgaatgctgttgtgacagactccagttataaacatctgcgagccatatggcacaactcatagctaaagaggccggtacagggcacatgcacagagctttgaagaacatacacaaacctgttgaatcaagttactttcctcatcctcagagactttgacaattcagagctcacagatggcagggggaattctcaggcttcccttcctcctgattgacactttttaaaggaagtgatgtggaagttgttctagaagttagatggacagtgggagcacattcgtgagtggggcttgggagagctcaaaagtggcactttgattttaggctgggcaggcagaagtctcacagtaaaatatatttcactagacgtccaaaccaacactgcattgtagtaacctcttctgaagtaactggttaaattaataactggtcccataagtcagggtcaagccacatttataacccattcgggccggccatgaagggttctgactcgacattggtatttaaatgctgttactttcccaatgcttagtagcacttgagactttatttccatcgacaaaaactaagaaggccacagaagtagcctaacagtcctccctggtcatactcgtttcaaacaggtctgcctgtctagacatattcaggcaggaggttgcttgctgctatcttgaaaaccactggaagattcagcttcttggggacctcagagcccatattcatatggaagcccacccatataagcctcacagagcaaatcacagcaatgttgaagttgttattttcaagtgcttatttcacgacattaaaaaaaatattttttcctggtgtattaaaattaaaaataaaatcataacttttgatttaaaatcaaa

SEQ ID NO: 129590 - DNA, 607 bp, Homo sapiens
  Payload ID: 5341
  Gene Symbol: ELOVL6
  Gene Name: ELOVL fatty acid elongase 6
  ENST ID: ENST00000514184
  CDS Start-End: 113-409
ctctcgcctatccactatcctcacactcagcatcccctgtctgtacgagattaaggagctctgccgtccgcagggcctggagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcaggtgctataacaacttgaaacagctgacattatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactaggagatacaatattcattattctgaggaagcagaagctgatcttcctgcactggtatcaccacatcactgtgctcctgtactcttggtactcct

SEQ ID NO: 129591 - DNA, 610 bp, Homo sapiens
  Payload ID: 5341
  Gene Symbol: ELOVL6
  Gene Name: ELOVL fatty acid elongase 6
  ENST ID: ENST00000506625
  CDS Start-End: 201-610
attcccttcactggtgatctcaacgtagatttgcccggagttctcttgcaagagagctggcaggttttactatttcccaatcgtttactcgccaagctctcgggtccacgcgccgcggggatgcgccctgcaagctgaaacttcattcaaagcaaggcggcccacgagagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcagtatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactaggagatacaatattcattattctgaggaagcagaagct

SEQ ID NO: 129592 - DNA, 458 bp, Homo sapiens
  Payload ID: 5341
  Gene Symbol: ELOVL6
  Gene Name: ELOVL fatty acid elongase 6
  ENST ID: ENST00000503885
  CDS Start-End: 133-458
ccacttccggctactagcctctctcgcctatccactatcctcacactcagcatcccctgtctgtacgagattaaggagctctgccgtccgcagggcctggagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcagtatattcggtgctcttcgaactggtgcttatatggtgtacattttgatgaccaaaggcctgaagcagtcagtttgtgaccagggtttttacaatggacctgtcag

SEQ ID NO: 129593 - DNA, 3827 bp, Homo sapiens
  Payload ID: 5342
  Gene Symbol: ELOVL7
  Gene Name: ELOVL fatty acid elongase 7
  Uniprot ID: A1L3X0
  ENST ID: ENST00000425382
  CDS Start-End: 150-995
aacccagtcggcggccgggacagcgggggccgctgtgaggagctccgcgctcgcgctgccagtcgccgccctctctcccgcgcgcgcccggcgcttcggctccgctccctgtgcgaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctgcaggtggtttgggaacattccatgcccttctaaatacagctgtacatgtagtcatgtattcctactatggactttctgcattggggccagcctaccagaagtatttgtggtggaaaaaatatttgacatcattacagcttgtccagtttgttattgtcgccatccacataagccagttctttttcatggaggattgcaagtatcagtttccagtctttgcgtgcatcattatgagttacagtttcatgtttctgctgctctttctccatttttggtaccgtgcttacaccaaaggtcagaggttgcccaaaactgtgaaaaatggaacttgcaaaaacaaagataattgaagcccaacataagtctatgatcgaaactgatacattgtcttccttgacaatcaagagatatttacctatgcagtgcattttgtatatttttcaaaactaagagcttgtatttttatggtaagttattgggatgtctgatatttgagagcccgaagcttccagataacagtcttctgataattagagcctacagcagccagaatttgtttttgtttttgtttttgtttttttagctgcttttaaacctaatccaaaggttttgtttaaaacattttgttgcagtgaaaaaaagatatgaagcaatacagtactcttcaaagaagtccaataaagatgaaaaatatcattaggtattttgagcacagacggagatccatgtgataaaatagattccttctgctgggtctggaaagtctggaaaccacctgtaggccctggctttgtcatttattgactgtattcagaagatactatatttgctctagagttaactcccattttagcaagctagcacaggtgaaaattgagtgagtttttgataacttgtcatttaaaatcattaatgataattttcaatggatcttttcagtagccatcaccagttttgctgataagacttcctcacaacccatttgttgtacaaactgtttcaaagtagcaatcctttgggttagtacacttgataccaagtttcattcagttgattattttcaaaacaaggtgatttgttttaatgggttaatgaatactttgctattactgttttacaattaactttgtatatctctggaaagaggtgaatttgtcaatgaaaaaagtattgtgtagttcagtgggaaaaacctgttgtctgttatagtatcacatcactttcttacattgtcatggtttaaattattatcttggtgaaatatataggttagatacttaaatgttcatattattagcacactacaggtactacccttaaatcataaataatattacccattgtacacagtttccagatatgagttagagtggctgtgaagcaactagaggcaaattgtggcacagagaatatccaggggaaaattgattatgtaagcaagggctgttctactttgagagagagacagacagactacataatagtaatatattatataattaatgttatagatacactgaacaataaaacattttctggaattatgaattaattaacaacctggatttctgtttccagacctataaaccatgtaatgaaggactgaaattcgtttggcatacactttgtttctttaaaattgctagtttctttctgttatttttacattttcttgtcagagaatcaaaactattagtcagtagagttttgtccatgaaataatatttggacatttgtgaatttttccctattttttttcttcttttatttatactcaattttgaagcactgtttatgtttgtaggactttaaacaattagtacttaaagccccagttaattttgaacacacagagatacttattgtactctgtgtacagtaagtatttttatgtttacacttaccagattcataaggttatttgcctttaagtgatcttttgtgattttacttgattacagcatgagaaggtaaaggttgataaatgggagtaattacatatatatatataatttattatttttttttctgaagcagagttttactcttgttgcccaggctagagtgcaatggcacaatctcggttcactgcaacctctgcctcccaggttcaagtgattctcctgtctcagcctcccaagtagctgggattacaggtgcccgccaccatgctcagctaatttttgtatttttagtagagacagggttggccaggctggtctcgagctcctgacctcaggtgatcctcccacctcggcctcccaaagttctgggattacaggggtgagccactgtgcccggccataattttatatttttagaaaataaagaatgaaggacaaaagagcacagctaaatgaaactgctgctctaatttattccactggaaaggtctcaggactccttaactgttttccaggtttggctcttcatatctaacctgtgctaaaatgagaaggtatgctaggtgctgttagaaatcacaccatttccaaagaacccaagtagtatagagaccaaaatgaggcaaaaataaaagagatgaaacaggagagtttatttcttgcatactttccgaccttcatcatacaacctctcctaacctccctgtagtctttaaaatgtttaacttgcctataagctaacatgtaataaaacacatactcaattatatgaatagaagtggagagccagaatgctacaaaagaaatcacagctgctagaagtatcctccatagaaacatcaacatgattgtggatcaaaatgattttcactggatatggaatttgtatgggccatatttattaaaagagttctgtgtggtcacatagagttcctttgggatttcatcccacttttcaggacttaatttgtttgggtttgcttacctaacaagcaacaacaacaacaaaataaatagttccaaaatctagtttattacataaatctctatgaatccttgagggcctatatctatattataaataaatacaaatatagatttttaaatatctatgggactttgccatttacagccttaagtataaaattacgagattatattctttccattaccctttatttctgctaactttttaaagactggaacattctgtggatgttgtcaaagtttgagtttgtttttccctgtgtattataataaatttgtggtattgcatgt

SEQ ID NO: 129594 - DNA, 4165 bp, Homo sapiens
  Payload ID: 5342
  Gene Symbol: ELOVL7
  Gene Name: ELOVL fatty acid elongase 7
  ENST ID: ENST00000505959
  CDS Start-End: 528-1334
cagtcgccgccctctctcccgcgcgcgcccggcgcttcggctccgctccctgtgcggcatttaaacttccctcttagaactgcttttgtggcatcccataagttttgaacccattaaaagagccagtaaatcctgtggaaaatggccttcagtgatcttacatcgaggactgtgcatctttatgataattggatcaaagatgctggttgattcttacctatcaactagaaattgcaagtctaccaaattcaggaaggaaatgcacacctcttggcacctaccacagatgaaattatagtcaaatttacaacgatttcagcaaagatacactgtttcatcatttgcagctttctcagcagactactaaagaccaaatttatctcactaaaagtgttcccaacagtttttcctttgaggaatgccaaggttctttcttcttcatttcattagtacttggaatcttaaagatgtactctttgagccagtacctgctacttaagaagagaatactctcttagaagcagctgatggaaaagcccattaatattctatatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctgcaggtggtttgggaacattccatgcccttctaaatacagctgtacatgtagtcatgtattcctactatggactttctgcattggggccagcctaccagaagtatttgtggtggaaaaaatatttgacatcattacagcttgtccagtttgttattgtcgccatccacataagccagttctttttcatggaggattgcaagtatcagtttccagtctttgcgtgcatcattatgagttacagtttcatgtttctgctgctctttctccatttttggtaccgtgcttacaccaaaggtcagaggttgcccaaaactgtgaaaaatggaacttgcaaaaacaaagataattgaagcccaacataagtctatgatcgaaactgatacattgtcttccttgacaatcaagagatatttacctatgcagtgcattttgtatatttttcaaaactaagagcttgtatttttatggtaagttattgggatgtctgatatttgagagcccgaagcttccagataacagtcttctgataattagagcctacagcagccagaatttgtttttgtttttgtttttgtttttttagctgcttttaaacctaatccaaaggttttgtttaaaacattttgttgcagtgaaaaaaagatatgaagcaatacagtactcttcaaagaagtccaataaagatgaaaaatatcattaggtattttgagcacagacggagatccatgtgataaaatagattccttctgctgggtctggaaagtctggaaaccacctgtaggccctggctttgtcatttattgactgtattcagaagatactatatttgctctagagttaactcccattttagcaagctagcacaggtgaaaattgagtgagtttttgataacttgtcatttaaaatcattaatgataattttcaatggatcttttcagtagccatcaccagttttgctgataagacttcctcacaacccatttgttgtacaaactgtttcaaagtagcaatcctttgggttagtacacttgataccaagtttcattcagttgattattttcaaaacaaggtgatttgttttaatgggttaatgaatactttgctattactgttttacaattaactttgtatatctctggaaagaggtgaatttgtcaatgaaaaaagtattgtgtagttcagtgggaaaaacctgttgtctgttatagtatcacatcactttcttacattgtcatggtttaaattattatcttggtgaaatatataggttagatacttaaatgttcatattattagcacactacaggtactacccttaaatcataaataatattacccattgtacacagtttccagatatgagttagagtggctgtgaagcaactagaggcaaattgtggcacagagaatatccaggggaaaattgattatgtaagcaagggctgttctactttgagagagagacagacagactacataatagtaatatattatataattaatgttatagatacactgaacaataaaacattttctggaattatgaattaattaacaacctggatttctgtttccagacctataaaccatgtaatgaaggactgaaattcgtttggcatacactttgtttctttaaaattgctagtttctttctgttatttttacattttcttgtcagagaatcaaaactattagtcagtagagttttgtccatgaaataatatttggacatttgtgaatttttccctattttttttcttcttttatttatactcaattttgaagcactgtttatgtttgtaggactttaaacaattagtacttaaagccccagttaattttgaacacacagagatacttattgtactctgtgtacagtaagtatttttatgtttacacttaccagattcataaggttatttgcctttaagtgatcttttgtgattttacttgattacagcatgagaaggtaaaggttgataaatgggagtaattacatatatatatataatttattatttttttttctgaagcagagttttactcttgttgcccaggctagagtgcaatggcacaatctcggttcactgcaacctctgcctcccaggttcaagtgattctcctgtctcagcctcccaagtagctgggattacaggtgcccgccaccatgctcagctaatttttgtatttttagtagagacagggttggccaggctggtctcgagctcctgacctcaggtgatcctcccacctcggcctcccaaagttctgggattacaggggtgagccactgtgcccggccataattttatatttttagaaaataaagaatgaaggacaaaagagcacagctaaatgaaactgctgctctaatttattccactggaaaggtctcaggactccttaactgttttccaggtttggctcttcatatctaacctgtgctaaaatgagaaggtatgctaggtgctgttagaaatcacaccatttccaaagaacccaagtagtatagagaccaaaatgaggcaaaaataaaagagatgaaacaggagagtttatttcttgcatactttccgaccttcatcatacaacctctcctaacctccctgtagtctttaaaatgtttaacttgcctataagctaacatgtaataaaacacatactcaattatatgaatagaagtggagagccagaatgctacaaaagaaatcacagctgctagaagtatcctccatagaaacatcaacatgattgtggatcaaaatgattttcactggatatggaatttgtatgggccatatttattaaaagagttctgtgtggtcacatagagttcctttgggatttcatcccacttttcaggacttaatttgtttgggtttgcttacctaacaagcaacaacaacaacaaaataaatagttccaaaatctagtttattacataaatctctatgaatccttgagggcctatatctatattataaataaatacaaatatagatttttaaatatctatgggactttgccatttacagccttaagtataaaattacgagattatattctttccattaccctttatttctgctaactttttaaagactggaacattctgtggatgttgtcaaagtttgagtttgtttttccctgtgtattataataaatttgtggtattgcatg

SEQ ID NO: 129595 - DNA, 595 bp, Homo sapiens
  Payload ID: 5342
  Gene Symbol: ELOVL7
  Gene Name: ELOVL fatty acid elongase 7
  ENST ID: ENST00000514809
  CDS Start-End: 86-352
gccgccctctctcccgcgcgcgcccggcgcttcggctccgctccctgtgcgaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagatactgttttaaaagaagaccttcccaccatcagactgaaagaattttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccg

SEQ ID NO: 129596 - DNA, 737 bp, Homo sapiens
  Payload ID: 5342
  Gene Symbol: ELOVL7
  Gene Name: ELOVL fatty acid elongase 7
  ENST ID: ENST00000511799
  CDS Start-End: 242-737
gagccgcatcctgtcttggtggctgctgctggccgggaggaggctgatgaatacagagccgtggaacaggtcgtgccggagatggaaacaggaaagcctgttgttttgtcgtcccagatacttaggaacttcaagcagtcgtcccagatataaaaggcatttaaacttccctcttagaactgcttttgtggcatcccataagttttgaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctg

SEQ ID NO: 129597 - DNA, 3994 bp, Homo sapiens
  Payload ID: 5342
  Gene Symbol: ELOVL7
  Gene Name: ELOVL fatty acid elongase 7
  Uniprot ID: A1L3X0
  ENST ID: ENST00000508821
  CDS Start-End: 316-1161
tccctccggccctcggcgggcacctggcggcggcgggcagggggcggcgctgcgcgcgtcacgcggctgggtgggatagcgggcaggtgacacccggcggcctcctcccctttccaacccagtcggcggccgggacagcgggggccgctgtgaggagctccgcgctcgcgctgccagtcgccgccctctctcccgcgcgcgcccggcgcttcggctccgctccctgtgcggcatttaaacttccctcttagaactgcttttgtggcatcccataagttttgaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctgcaggtggtttgggaacattccatgcccttctaaatacagctgtacatgtagtcatgtattcctactatggactttctgcattggggccagcctaccagaagtatttgtggtggaaaaaatatttgacatcattacagcttgtccagtttgttattgtcgccatccacataagccagttctttttcatggaggattgcaagtatcagtttccagtctttgcgtgcatcattatgagttacagtttcatgtttctgctgctctttctccatttttggtaccgtgcttacaccaaaggtcagaggttgcccaaaactgtgaaaaatggaacttgcaaaaacaaagataattgaagcccaacataagtctatgatcgaaactgatacattgtcttccttgacaatcaagagatatttacctatgcagtgcattttgtatatttttcaaaactaagagcttgtatttttatggtaagttattgggatgtctgatatttgagagcccgaagcttccagataacagtcttctgataattagagcctacagcagccagaatttgtttttgtttttgtttttgtttttttagctgcttttaaacctaatccaaaggttttgtttaaaacattttgttgcagtgaaaaaaagatatgaagcaatacagtactcttcaaagaagtccaataaagatgaaaaatatcattaggtattttgagcacagacggagatccatgtgataaaatagattccttctgctgggtctggaaagtctggaaaccacctgtaggccctggctttgtcatttattgactgtattcagaagatactatatttgctctagagttaactcccattttagcaagctagcacaggtgaaaattgagtgagtttttgataacttgtcatttaaaatcattaatgataattttcaatggatcttttcagtagccatcaccagttttgctgataagacttcctcacaacccatttgttgtacaaactgtttcaaagtagcaatcctttgggttagtacacttgataccaagtttcattcagttgattattttcaaaacaaggtgatttgttttaatgggttaatgaatactttgctattactgttttacaattaactttgtatatctctggaaagaggtgaatttgtcaatgaaaaaagtattgtgtagttcagtgggaaaaacctgttgtctgttatagtatcacatcactttcttacattgtcatggtttaaattattatcttggtgaaatatataggttagatacttaaatgttcatattattagcacactacaggtactacccttaaatcataaataatattacccattgtacacagtttccagatatgagttagagtggctgtgaagcaactagaggcaaattgtggcacagagaatatccaggggaaaattgattatgtaagcaagggctgttctactttgagagagagacagacagactacataatagtaatatattatataattaatgttatagatacactgaacaataaaacattttctggaattatgaattaattaacaacctggatttctgtttccagacctataaaccatgtaatgaaggactgaaattcgtttggcatacactttgtttctttaaaattgctagtttctttctgttatttttacattttcttgtcagagaatcaaaactattagtcagtagagttttgtccatgaaataatatttggacatttgtgaatttttccctattttttttcttcttttatttatactcaattttgaagcactgtttatgtttgtaggactttaaacaattagtacttaaagccccagttaattttgaacacacagagatacttattgtactctgtgtacagtaagtatttttatgtttacacttaccagattcataaggttatttgcctttaagtgatcttttgtgattttacttgattacagcatgagaaggtaaaggttgataaatgggagtaattacatatatatatataatttattatttttttttctgaagcagagttttactcttgttgcccaggctagagtgcaatggcacaatctcggttcactgcaacctctgcctcccaggttcaagtgattctcctgtctcagcctcccaagtagctgggattacaggtgcccgccaccatgctcagctaatttttgtatttttagtagagacagggttggccaggctggtctcgagctcctgacctcaggtgatcctcccacctcggcctcccaaagttctgggattacaggggtgagccactgtgcccggccataattttatatttttagaaaataaagaatgaaggacaaaagagcacagctaaatgaaactgctgctctaatttattccactggaaaggtctcaggactccttaactgttttccaggtttggctcttcatatctaacctgtgctaaaatgagaaggtatgctaggtgctgttagaaatcacaccatttccaaagaacccaagtagtatagagaccaaaatgaggcaaaaataaaagagatgaaacaggagagtttatttcttgcatactttccgaccttcatcatacaacctctcctaacctccctgtagtctttaaaatgtttaacttgcctataagctaacatgtaataaaacacatactcaattatatgaatagaagtggagagccagaatgctacaaaagaaatcacagctgctagaagtatcctccatagaaacatcaacatgattgtggatcaaaatgattttcactggatatggaatttgtatgggccatatttattaaaagagttctgtgtggtcacatagagttcctttgggatttcatcccacttttcaggacttaatttgtttgggtttgcttacctaacaagcaacaacaacaacaaaataaatagttccaaaatctagtttattacataaatctctatgaatccttgagggcctatatctatattataaataaatacaaatatagatttttaaatatctatgggactttgccatttacagccttaagtataaaattacgagattatattctttccattaccctttatttctgctaactttttaaagactggaacattctgtggatgttgtcaaagtttgagtttgtttttccctgtgtattataataaatttgtggtattgcatgta

SEQ ID NO: 129598 - DNA, 1034 bp, Homo sapiens
  Payload ID: 5342
  Gene Symbol: ELOVL7
  Gene Name: ELOVL fatty acid elongase 7
  ENST ID: ENST00000504455
  CDS Start-End: 69-284
attataaactcatttctgttttattttactgaagaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataactttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctgcaggtggtttgggaacattccatgcccttctaaatacagctgtacatgtagtcatgtattcctactatggactttctgcattggggccagcctaccagaagtatttgtggtggaaaaaatatttgacatcattacagcttgtccagtttgttattgtcgccatccacataagccagttctttttcatggaggattgcaagtatcagtttccagtctttgcgtgcatcattatgagttacagtttcatgtttctgctgctctttctccatttttggtaccgtgcttacaccaaaggtcagaggttgcccaaaactgtgaaaaatggaacttgcaaaaacaaagataattgaagcccaacataagtctatgatcgaaactgatacattgtcttccttgacaatcaagagatatttacctatgcagtgcattttgtatatttttcaaaactaagagcttgtatttttatggtaagttattgggatgtctgatatttgagagcccgaagcttccagataa

SEQ ID NO: 129599 - DNA, 730 bp, Homo sapiens
  Payload ID: 5342
  Gene Symbol: ELOVL7
  Gene Name: ELOVL fatty acid elongase 7
  ENST ID: ENST00000507047
  CDS Start-End: 235-730
agtcggcggccgggacagcgggggccgctgtgaggagctccgcgctcgcgctgccagtcgccgccctctctcccgcgcgcgcccggcgcttcggctccgctccctgtgcgatacttaggaacttcaagcagtcgtcccagatataaaaggcatttaaacttccctcttagaactgcttttgtggcatcccataagttttgaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctg

SEQ ID NO: 129600 - DNA, 4281 bp, Homo sapiens
  Payload ID: 5343
  Gene Symbol: EMB
  Gene Name: embigin
  Uniprot ID: Q6PCB8
  ENST ID: ENST00000303221
  CDS Start-End: 217-1200
gcataactgatggagggccgggcgcggtaagagcgtctcgggggagtggggcaaggcggccgggcccctcccattccgccttttcttcagcgtcctacccgcggcactggctgcgagcgccgggccacctgcgagtgtgcgcagggactctggacacccgcggcggcgagctgagggagcagtctccacgaggacccaggcggaccctctggcgccatgcgcgccctccccggcctgctggaggccagggcgcgtacgccccggctgctcctcctccagtgccttctcgctgccgcgcgcccaagctcggcggacggcagtgccccagattcgccttttacaagtccacctctcagagaagaaataatggcaaataacttttccttggagagtcataacatatcactgactgaacattctagtatgccagtagaaaaaaatatcactttagaaaggccttctaatgtaaatctcacatgccagttcacaacatctggggatttgaatgcagtaaatgtgacttggaaaaaagatggtgaacaacttgagaataattatcttgtcagtgcaacaggaagcaccttgtatacccaatacaggttcaccatcattaatagcaaacaaatgggaagttattcttgtttctttcgagaggaaaaggaacaaaggggaacatttaatttcaaagtccctgaacttcatgggaaaaacaagccattgatctcttacgtaggggattctactgtcttgacatgtaaatgtcaaaattgttttcctttaaattggacctggtacagtagtaatgggagtgtaaaggttcctgttggtgttcaaatgaataaatatgtgatcaatggaacatatgctaacgaaacaaagctgaagataacacaacttttggaggaagatggggaatcttactggtgccgtgcactattccaattaggcgagagtgaagaacacattgagcttgtggtgctgagctatttggtgcccctcaaaccatttcttgtaatagtggctgaggtgattcttttagtggccaccattctgctttgtgaaaagtacacacaaaagaaaaagaagcactcagatgaggggaaagaatttgagcagattgaacagctgaaatcagatgatagcaatggtatagaaaataatgtccccaggcatagaaaaaatgagtctctgggccagtgaatacaaaacatcatgtcgagaatcattggaagatatacagagttcgtatttcagctttgtttatccttcctgttaagagcctctgagtttttagttttaaaaggatgaaaagcttatgcaacatgctcagcaggagcttcatcaacgatatatgtcagatctaaaggtatattttcattctgtaattatgttacataaaagcaatgtaaatcagaataaatatgttagaccagaataaaattaattatattctggtcttcaaaggacacacagaacagatatcagcagaatcacttaatacttcatagaacaaaaatcactcaaaacctgtttataaccaaagaattcatgaaaaagaaagcctttgccatttgtcttagaaagttattttttaaaaaaaaatcatacttactattagtatctatggaagtatatgtaacaatttttatgtaaaggtcatctttctgtgatagtgaaaaaatatgtctttactaagttgaaatgaatactttctgcctttgctaatgatagttattctacaatctccacaagaaaaatataccttttatccggaaatattggtttaaggcaaataaataaaactgtgcttgctctaaagctctgcactacaaaagcaaattttccagtctttattccactcataaccactgctttccccaccaggctaaagtgcttcttagtcttaaatagggtttttaacttcataaggtacaccattgtttatgttttagggtgcaggtccatatagtcgtaatacttaaaacactgctacactgatgcttttgtggctcatggtttcctggttctttgatttaacacctggcttcctggtatctatggctggttaaatatctaaacctgcattattagtgctttacaataataattcccttgactgaagtccagaaatactaaagcacttcttttttattgctgtgaatgccttagacttatcttccaaaataggatacttcgtttctattgcatatataactgaaatattttataaactcactgtaatcaaatcttataaaatctgaatcaacatgaaaagttgtcaatgcttgaatgaatactaaaatcataccacaagatactagataacataaatgaccatgaagtgtcccactgctcaaagggcaacaactttaagaacagaagcaaagagtggtggtgtggaacccaagattcttggcgactagggaatttaaaggttggggaggaggaattcaatgatttgacaagaaatactttataaaaatttgctccatgtattggctaagaaaaatataataaaattttggtagtgaaaattgtatcactaatgtttaccaatattactagtatgaataatacacataaggtagtgacttggaagctgctcaatactttgttgctataacaaaatgcaatattttgttgtaaagcatcttaactacacatataagtttgctgaacttgaatacatcccggtaatggcaaacttcattttattcttggttttcattttattctggtctcagggccatacatttattttagtttaattaattattattttgacaacattacttgggtaatatctatataatggtagataaccaatcagttagcttaattaatctaagctatttgaattcagggaaatattagtcaaatctgctgtttgactaaatacaattcaaagcagtgtatttgtgacttggaatatagaacacaaacaaatgtgtaacccatctgcagtatgcattcttccattttaccaccactaaccattgaggctcatacaattttcaagcaacaagcattgcttcccaaaggtaaaataatcaggaatatttctatagtaaatggagtttttaattggcaatactgtttatttttttctagcaaagacaatttatctcagtaaccttaaataggaaaagtactcaaaaattaaagttgacttttggctttttgtagtctctctggaggacttccagaaaattaccactgttggattttaatctgcttccattaaccaatcttacagagatgataaatgaattaactaatattgaccaaatataaattgactgcaaataataagccgcataaaagttgaagtaggaaaactactccaagtttatatattaggcaccttggggaattctcttagtctttccagctaacaaggattttcagcataataagtagatttaatgatggcataaaattcccagatactttcatatacattttttgccaaagtgtaaatcttctccttttgcagtctttttgttattatcccaacatctagctgctcaggccctaatttagaactcattctgatattttcttcttctgtattaattaatacttatgggtcatgaatccctgctcctttgacctttttaatagctcatgaatccatcccattgcctccccaactctgcccacacctgctgcaacactaatgccttgattttcctacctcagtctccttttctattaatccctcttttgcgtggctgcctgagtccactttctcaaacacaaacctcactatgcaactttggaatctctgtaggctcacctttgccatttcttaatattgcattctccaaattgctaatctctatccagtctcttgaactagacttggcacatggagattccgctcagaaagtgctcttcacacttctacctgcttgactaaccccagattatctttcaagactttaatctgatcttgtgtcttagagaagcccccatacctggtagagcatgtaccatcttacatgcttaaataactccacatttatttgtgtttattactctgtgttataaatatacatttgttggtctctctcttggattattttgtttctttgtcctgtaactaccactgaaagggtgcaatacagctttcttgaaatgtgtattgaacggatgaatgtataaataaaaattaaattttgtaaatttctgcttattcttagaaaaagaatctaaattgtgacaaatcagaattgaaaaaagtattctaataaagaaaaacaagcttttataacttca

SEQ ID NO: 129601 - DNA, 1617 bp, Homo sapiens
  Payload ID: 5343
  Gene Symbol: EMB
  Gene Name: embigin
  ENST ID: ENST00000508934
  CDS Start-End: 200-1021
ccgggcgcggtaagagcgtctcgggggagtggggcaaggcggccgggcccctcccattccgccttttcttcagcgtcctacccgcggcactggctgcgagcgccgggccacctgcgagtgtgcgcagggactctggacacccgcggcggcgagctgagggagcagtctccacgaggacccaggcggaccctctggcgccatgcgcgccctccccggcctgctggaggccagggcgcgtacgccccggctgctcctcctccagtgccttctcgctgccgcgcgcccaagctcggcggacggcagtgccccagattcgccttttacaagtccacctctcagagaagaaataatggcaaataacttttccttggagagtcataacatatcactgactggaagcaccttgtatacccaatacaggttcaccatcattaatagcaaacaaatgggaagttattcttgtttctttcgagaggaaaaggaacaaaggggaacatttaatttcaaagtccctgaacttcatgggaaaaacaagccattgatctcttacgtaggggattctactgtcttgacatgtaaatgtcaaaattgttttcctttaaattggacctggtacagtagtaatgggagtgtaaaggttcctgttggtgttcaaatgaataaatatgtgatcaatggaacatatgctaacgaaacaaagctgaagataacacaacttttggaggaagatggggaatcttactggtgccgtgcactattccaattaggcgagagtgaagaacacattgagcttgtggtgctgagctatttggtgcccctcaaaccatttcttgtaatagtggctgaggtgattcttttagtggccaccattctgctttgtgaaaagtacacacaaaagaaaaagaagcactcagatgaggggaaagaatttgagcagattgaacagctgaaatcagatgatagcaatggtatagaaaataatgtccccaggcatagaaaaaatgagtctctgggccagtgaatacaaaacatcatgtcgagaatcattggaagatatacagagttcgtatttcagctttgtttatccttcctgttaagagcctctgagtttttagttttaaaaggatgaaaagcttatgcaacatgctcagcaggagcttcatcaacgatatatgtcagatctaaaggtatattttcattctgtaattatgttacataaaagcaatgtaaatcagaataaatatgttagaccagaataaaattaattatattctggtcttcaaaggacacacagaacagatatcagcagaatcacttaatacttcatagaacaaaaatcactcaaaacctgtttataaccaaagaattcatgaaaaagaaagcctttgccatttgtcttagaaagttattttttaaaaaaaaatcatacttactattagtatctatggaagtatatgtaacaatttttatgtaaaggtcatctttctgtgatagtgaaaaaatatgtctttactaagttgaaatgaatactttctgcctttgctaatgatagttattctacaatctccacaagaaaaatataccttttatccggaaatattggtttaaggcaaataa

SEQ ID NO: 129602 - DNA, 1475 bp, Homo sapiens
  Payload ID: 5343
  Gene Symbol: EMB
  Gene Name: embigin
  Uniprot ID: Q6PCB8
  ENST ID: ENST00000514111
  CDS Start-End: 308-1141
agaaaacaaatagcaacccaaactggcccgtcagccattttatcttctctgttccctggtgcccagtgctatctatttttttttttaattctctttattaaggtctgcctgtcgctcttctttcatcttctctctctgcctcttcatatctttccattttctggctctctcatctgattccttggtatcttcagtttatttatgttttgtaaagaaactataatagtagaataaaaatggaaggcgttatttaaaaaaagccatctgatattcgccttttacaagtccacctctcagagaagaaataatggcaaataacttttccttggagagtcataacatatcactgactgaacattctagtatgccagtagaaaaaaatatcactttagaaaggccttctaatgtaaatctcacatgccagttcacaacatctggggatttgaatgcagtaaatgtgacttggaaaaaagatggtgaacaacttgagaataattatcttgtcagtgcaacaggaagcaccttgtatacccaatacaggttcaccatcattaatagcaaacaaatgggaagttattcttgtttctttcgagaggaaaaggaacaaaggggaacatttaatttcaaagtccctgaacttcatgggaaaaacaagccattgatctcttacgtaggggattctactgtcttgacatgtaaatgtcaaaattgttttcctttaaattggacctggtacagtagtaatgggagtgtaaaggttcctgttggtgttcaaatgaataaatatgtgatcaatggaacatatgctaacgaaacaaagctgaagataacacaacttttggaggaagatggggaatcttactggtgccgtgcactattccaattaggcgagagtgaagaacacattgagcttgtggtgctgagctatttggtgcccctcaaaccatttcttgtaatagtggctgaggtgattcttttagtggccaccattctgctttgtgaaaagtacacacaaaagaaaaagaagcactcagatgaggggaaagaatttgagcagattgaacagctgaaatcagatgatagcaatggtatagaaaataatgtccccaggcatagaaaaaatgagtctctgggccagtgaatacaaaacatcatgtcgagaatcattggaagatatacagagttcgtatttcagctttgtttatccttcctgttaagagcctctgagtttttagttttaaaaggatgaaaagcttatgcaacatgctcagcaggagcttcatcaacgatatatgtcagatctaaaggtatattttcattctgtaattatgttacataaaagcaatgtaaatcagaataaatatgttagaccagaataaaattaattatattctggtcttcaaaggacacacagaacagatatcagcagaatcacttaatacttcatagaacaaaaatcactcaaaacctgttta

SEQ ID NO: 129603 - DNA, 3118 bp, Homo sapiens
  Payload ID: 5344
  Gene Symbol: EFS
  Gene Name: embryonal Fyn-associated substrate
  Uniprot ID: O43281
  ENST ID: ENST00000216733
  CDS Start-End: 609-2294
ctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcgacccagctggcccgggcactgtatgacaacaccgctgagtccccccaggagctgtccttccgccgaggggatgtcctacgggtcctgcagagagagggcgctggtggactggacggctggtgcctctgctccctacacggccagcagggcattgtgcccgccaacagggtgaagctcttgcctgctggcccagcacccaagcccagcctctctcctgcgtccccagcccagcctggctcaccatatccagccccagatcacagcaatgaggaccaggaggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccctgctgtctgcctccctgactctgcttcttgggagcatggtgagcagccctggtgctcagcagccatacctatgggacacacactacgaaaaggatgcctttagggtttgggggagattttactcctttcttcaacaactattcactggacaagttctctgctcccatgacgcgccaggcacagttctgcaagtatattgtgaatgtattgttctagtgggatacacaaataagtcagttaaaatacataaataaaaacataaacctgccata

SEQ ID NO: 129604 - DNA, 2704 bp, Homo sapiens
  Payload ID: 5344
  Gene Symbol: EFS
  Gene Name: embryonal Fyn-associated substrate
  Uniprot ID: O43281
  ENST ID: ENST00000351354
  CDS Start-End: 728-2134
cgggcgcgctgagtgagtgcgcgcgtgaaaaccgccgcaccgccgggggtgcgagtgtctgggccgaagcggccactccagcgacccagccccacggccacgctctcgggggcctttggctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccctgctgtctgcctccctga

SEQ ID NO: 129605 - DNA, 2610 bp, Homo sapiens
  Payload ID: 5344
  Gene Symbol: EFS
  Gene Name: embryonal Fyn-associated substrate
  Uniprot ID: O43281
  ENST ID: ENST00000429593
  CDS Start-End: 609-1787
ctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccctgctgtctgcctccctgactctgcttcttgggagcatggtgagcagccctggtgctcagcagccatacctatgggacacacactacgaaaaggatgcctttagggtttgggggagattttactcctttcttcaacaactattcactggacaagttctctgctcccatgacgcgccaggcacagttctgcaagtatattgtgaatgtattgttctagtgggatacacaaataagtcagttaaaatacataaataaaaacataaacctgccat

SEQ ID NO: 129606 - DNA, 2223 bp, Homo sapiens
  Payload ID: 5345
  Gene Symbol: EED
  Gene Name: embryonic ectoderm development
  Uniprot ID: O75530
  ENST ID: ENST00000263360
  CDS Start-End: 687-2012
attcgccagatgggggaagccagggggaagcaggttactgtttttgcatttctatcttcaaggaagaattaggttatgaatagttccgtgaatagtcaggaagcgctgtcctccaagttcaagattaaggaaacgtggcatgcacagctaaagcaagaggtgacgtcttgtatcttcccccgtttcctgggacattggtggtgtagcccattccacagactttcgctccctagcagcgggtcggagatcgaaggaacgggccaattgcggctgaaacgtctttggaaggaggaagggggtgagggagcatccctttgagtttcgcctcttctcgaggcggtggtgggaagggagacatacttaatactgccctcttaatccaacggaccttacatcgtgtagactgccgggagggcggcgggaaaagggcaagacgggagttggggaagggaaggagccaggaagccgcgcgggagggcgcgcgcgcgcgcccctttttcagcagtgtggcggggtcgcacgcacgcccgcctcggcggctgggcgcgatttgcgacagtggggggggcggtggaggtggcggcggcagcggcaactttgcggcaagctcgggccgggcttgcttgacggcggtgtggcggaggccccgccccaggcggcaggaacctggagggaggcggaggaatatgtccgagagggaagtgtcgactgcgccggcgggaacagacatgcctgcggccaagaagcagaagctgagcagtgacgagaacagcaatccagacctctctggagacgagaatgatgacgctgtcagtatagaaagtggtacaaacactgaacgccctgatacacctacaaacacgccaaatgcacctggaaggaaaagttggggaaagggaaaatggaagtcaaagaaatgcaaatattctttcaaatgtgtaaatagtctcaaggaagatcataaccaaccattgtttggagttcagtttaactggcacagtaaagaaggagatccattagtgtttgcaactgtaggaagcaacagagttaccttgtatgaatgtcattcacaaggagaaatccggttgttgcaatcttacgtggatgctgatgctgatgaaaacttttacacttgtgcatggacctatgatagcaatacgagccatcctctgctggctgtagctggatctagaggcataattaggataataaatcctataacaatgcagtgtataaagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttgt

SEQ ID NO: 129607 - DNA, 2033 bp, Homo sapiens
  Payload ID: 5345
  Gene Symbol: EED
  Gene Name: embryonic ectoderm development
  Uniprot ID: O75530
  ENST ID: ENST00000327320
  CDS Start-End: 91-1293
tttgcggcaagctcgggccgggcttgcttgacggcggtgtggcggaggccccgccccaggcggcaggaacctggagggaggcggaggaatatgtccgagagggaagtgtcgactgcgccggcgggaacagacatgcctgcggccaagaagcagaagctgagcagtgacgagaacagcaatccagacctctctggagacgagaatgatgacgctgtcagtatagaaagtggtacaaacactgaacgccctgatacacctacaaacacgccaaatgcacctggaaggaaaagttggggaaagggaaaatggaagtcaaagaaatgcaaatattctttcaaatgtgtaaatagtctcaaggaagatcataaccaaccattgtttggagttcagtttaactggcacagtaaagaaggagatccattagtgtttgcaactgtaggaagcaacagagttaccttgtatgaatgtcattcacaaggagaaatccggttgttgcaatcttacgtggatgctgatgctgatgaaaacttttacacttgtgcatggacctatgatagcaatacgagccatcctctgctggctgtagctggatctagaggcataattaggataataaatcctataacaatgcagtgtataaagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaagtaagtatttagaaatttctgttcaaaatttcaggctttttctccacacttgtatgccaatgtagagaagatcatttatatttgcagtgccatccttaagtcatttttaacatttactgttttcagagttaaagttattcttttttattccaataatttttgtttttcctaagtaccttggtgacaagtcatttcttgtttttatacaaattatgtagtgcttgttgaacttaaaatatatctaaattttataaaatttgagactgagctcttagtgaagtatattctggttttaagtgcttttcgtatgacttggaacatctgcttattttctaatccgctgttttagggtagacactgacaacgttatgtgtggtctttaacctgttgtcatgttttttccctagatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttg

SEQ ID NO: 129608 - DNA, 1696 bp, Homo sapiens
  Payload ID: 5345
  Gene Symbol: EED
  Gene Name: embryonic ectoderm development
  Uniprot ID: O75530
  ENST ID: ENST00000351625
  CDS Start-End: 8-1408
gaggaatatgtccgagagggaagtgtcgactgcgccggcgggaacagacatgcctgcggccaagaagcagaagctgagcagtgacgagaacagcaatccagacctctctggagacgagaatgatgacgctgtcagtatagaaagtggtacaaacactgaacgccctgatacacctacaaacacgccaaatgcacctggaaggaaaagttggggaaagggaaaatggaagtcaaagaaatgcaaatattctttcaaatgtgtaaatagtctcaaggaagatcataaccaaccattgtttggagttcagtttaactggcacagtaaagaaggagatccattagtgtttgcaactgtaggaagcaacagagttaccttgtatgaatgtcattcacaaggagaaatccggttgttgcaatcttacgtggatgctgatgctgatgaaaacttttacacttgtgcatggacctatgatagcaatacgagccatcctctgctggctgtagctggatctagaggcataattaggataataaatcctataacaatgcagtgtataaagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagagtggccgtgccattttacattcccaccagcaatgtatgagagatccagtgtctccgaatcttcgccagcatttgtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttgtaaagctgtgtgtttagttactttcattgtggtgaaaaaaagttaaaagtaataaaattatgccttatctttttataa

SEQ ID NO: 129609 - DNA, 1745 bp, Homo sapiens
  Payload ID: 5345
  Gene Symbol: EED
  Gene Name: embryonic ectoderm development
  ENST ID: ENST00000528180
  CDS Start-End: 478-1563
attccacagactttcgctccctagcagcgggtcggagatcgaaggaacgggccaattgcggctgaaacgtctttggaaggaggaagggggtgagggagcatccctttgagtttcgcctcttctcgaggcggtggtgggaagggagacatacttaatactgccctcttaatccaacggaccttacatcgtgtagactgccgggagggcggcgggaaaagggcaagacgggagttggggaagggaaggagccaggaagccgcgcgggagggcgcgcgcgcgcgcccctttttcagcagtgtggcggggtcgcacgcacgcccgcctcggcggctgggcgcgatttgcgacagtggggggggcggtggaggtggcggcggcagcggcaactttgcggcaagctcgggccgggcttgcttgacggcggtgtggcggaggccccgccccaggcggcaggaacctggagggaggcggaggaatatgtccgagagggaagtgtcgactgcgccggcgggaacagacatgcctgcggccaagaagcagaagctgagcagtgacgagaacagcaatccagacctctctggagacgagaatgatgacgctgtcagtatagaaagtggtacaaacactgaacgccctgatacacctacaaacacgccaaatgcacctggaaggaaaagttggggaaagggaaaatggaagtcaaagaaatgcaaatattctttcaaatgtgtaaatagtctcaaggaagatcataaccaaccattgtttggagttcagtttaactggcacagtaaagaaggagatccattagtgtttgcaactgtaggaagcaacagagttaccttgtatgaatgtcattcacaaggagaaatccggttgttgcaatcttacgtggatgctgatgctgatgaaaacttttacacttgtgcatggacctatgatagcaatacgagccatcctctgctggctgtagctggatctagaggcataattaggataataaatcctataacaatgcagtgtataaagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgcttcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactc

SEQ ID NO: 129610 - DNA, 713 bp, Homo sapiens
  Payload ID: 5345
  Gene Symbol: EED
  Gene Name: embryonic ectoderm development
  ENST ID: ENST00000534595
  CDS Start-End: 1-347
ccgagagggaagtgtcgactgcgccggcgggaacagacatgcctgcggccaagaagcagaagctgagcagtgacgagaacagcaatccagacctctctggagacgagaattcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaagtaagtatttagaaatttctgttcaaaatttcaggctttttctccacacttgtatgccaatgtagagaagatcatttatatttgcagtgccatccttaagtcatttttaacatttactgttttcagagttaaagttattcttttttattccaataatttttgtttttcctaagtaccttggtgacaagtcatttcttgtttttatacaaattatgtagtgcttgttgaacttaaaatatatctaaattttataaaatttgagactgagctcttagtgaagtatattctggttttaagtgcttttcgtatgacttggaacatctgcttattttctaatccgctgttttagggtagacactgacaacgttat

SEQ ID NO: 129611 - DNA, 1422 bp, Homo sapiens
  Payload ID: 5345
  Gene Symbol: EED
  Gene Name: embryonic ectoderm development
  ENST ID: ENST00000527888
  CDS Start-End: 888-1208
atctttggcctctacccattagagcacagacacattgtcaaatgtcccttcgtgggcaaaccactgacctagacagtaatatgaatagtgcccacagttttgcaattttttctcattgtattctttaccacttactgcttaggtatgtgcatacaaatttgattttataggataggaaaagtataagtttgaagcctatttcaatcctatccccatatgagtgtcttgatgttaaacaactgctttacttgccttcgattgccctatttataaactgaattctaaggctatttatgtgagttcatcaactttcctaagatacctgttgagtacctactgtgtggcacagatactggatgaaggaataatagttaataaggtaaaggaaaccacctgtgattagaagcgaaatgggagactgcatggggaaagatgaaactagtgaagtaagcaagagccagattaatgccggattctgaaaagccatgtattctaattctgtgtgtttgtaattgacctgtgctataaaacacttaaagtctctgggtgtcagagtatctagagctgaacttggtttaacttgaaagagaaatgttgacttccaaaatgaatatttcagacaatgtgattcttttgtattatcgaattctgttgataatcagatttcttgtccttaagtatggtcattgactgtaaatataaatgaatgtacatcactgtacttgatagatggattaaccaggttctaagagctgtgaattccaaaacaatagaaaagccttgtttttactttgtaagattcagttcctcattaacatttctttttctcatttctctctctgttttagtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttgtaaa

SEQ ID NO: 129612 - DNA, 966 bp, Homo sapiens
  Payload ID: 5346
  Gene Symbol: EMD
  Gene Name: emerin
  ENST ID: ENST00000369835
  CDS Start-End: 213-872
tcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtagacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggca

SEQ ID NO: 129613 - DNA, 1379 bp, Homo sapiens
  Payload ID: 5346
  Gene Symbol: EMD
  Gene Name: emerin
  Uniprot ID: P50402
  ENST ID: ENST00000369842
  CDS Start-End: 289-1053
gacgtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 129614 - DNA, 946 bp, Homo sapiens
  Payload ID: 5346
  Gene Symbol: EMD
  Gene Name: emerin
  ENST ID: ENST00000428228
  CDS Start-End: 125-190
gacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtggggg

SEQ ID NO: 129615 - DNA, 4898 bp, Homo sapiens
  Payload ID: 5347
  Gene Symbol: EMG1
  Gene Name: EMG1 N1-specific pseudouridine methyltransferase
  Uniprot ID: Q92979
  ENST ID: ENST00000599672
  CDS Start-End: 32-766
gcgttagcgcaacttccggtattgttgcaagatggccgcgcccagtgatggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatggttcaacttttacacaagctcagtgttcgagcagctgatggcccccagaagcttttgaaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccagctacttgggaggctgaggcaggaaaatcacttgaacccaggaggtggaggttgcggtgagctgagatcccgccactgcattccagcgtgggtgacaaagcaagacgccttctccaaaaaaaagtttcccctttggccccaaatgaagacttggctggcagcagaggcacagctggaagcatcgatcttccacctccctggcttttccattctctgctctggggcaaaggagtgctgtgaaaagggagacgagtagtttctgcaccagtcccgcacaggccacctgcaagacaagaggagtttggaaggctggttagttactcctgtaattcctggtctatagcccttccagatgtttcctagcatgcctcaataagtcacagtagtcattgcccatactgtgttccttagtagccaggctaatccttggaattcaccccagatttctaatactattgtttttttccagtctgttgctctattctgtaacctggtggtagttttagtttagctgtattaacttaccagggaaatggattattccatcttctttaacttctctttccttggcaccattgctttgtgaatataaggcaatatgaatagtaggctcaggaagaagatgtggccaaggaaatagatggatttatacacctgtggagagagaggccactaaggtagacaggcctggagtgtcctttgcaacctttgaggttgcagtgagtccctcccagtctcacaagcaggccttcacttgccttaagccatttgtcccacgtgaagaggcagaaggcagtcatggagtaacccatgaagagccagtggatggtctgttgcaccaaatagtagaagggctggaggacagtaatggcggccagcttgctcagggtggggctctcttgaatgagcctggcagcctggggagggaggaggagctcatcagcatcttgtcccttatattccccttcacccccaccctggaggcctacctgtctttccacaataacaatgaggaattccatctggaagcagaccaggtatcctgagtgcaggccgtgccagagggccaggaatagcaacgagagaccctgagagagttctttatttccaaggaacttgagtcgtttgaagatgtagctggagaaaagggtgggtggggcgaccctcaaactgactggtccttgcatcccgccacctgcctctgggtcctcaccctgaggattggattggagtgctggtgggttcccacgtgtagcccccagagggtacaggaggcagtgctgactgattacttttagagatggaaagcagacccaaggcggagctggagaccgtgtgcgcacgagccacttggttcagcagcagtgactgaggctgatgctgagatcagtggtgaaccagacactctactcaagctgcccacactctagtggtggggacaaacaagtaaagctgttgataaacagggcagtggaggacataagtccattggcagagctggagtaacacccaggtcttaacgcacttttatatcttgcctttttttcaaatatgacagtaatggtttttttgggaggggggtataggtgggggtcaaagtcagtgtgagcgacagggggttctgcccagatgggaaagacgcataggggtgacatggtacacccctgccctccaatctgggaagacagtggaaggaaggaaccagggtccaggctccccaccagcagctcaccgggccacccaggcgttggtgttgatgttgaatgaggcaatggtgccagtgaagcgggggtttgtttcaaagagccacaccttcatgttggcacaggcatcccactttgccttgcccttttcttcaaagccattgaagcccaggcccgtcaaaatgcatactccttcctgagagggaatagctcagttagggctcttgccactccccatactggcccccatggcttgtctaaataggaccttgtttcaacttttctacttactgtgaccagccaacaggtgacatatttgtacagcacaaacttgccccagatcagcatgtacatgcagcggaaccagaaggggtggttcttgagggaagaaagcacagtgcattagggatatcacatgactaggcagtttctctcagcactcttccttttcacacttgtggctggctacttcatacctgcctgagtcctgctgccagatgccctcaatagtctggcctgattgccttcacaataggcagagaggaataagcagagggcctggagaatattcattcgcctttcccttggagagcctcaagggcagcactgtatttaacttctctactgtttgccttcgttggcaaagtgtttggaatgagcatttggaatgttaagtacagaggggcccatattggattttaatttaaggagagaaacctgcccagaattactgaactgttttcaagcctttcagctgggcaggagcaaaagccagcacttccccccttcccttggtttctgaattccctagaagtgcccaaatgtatcagtcaagagaagaaaataggatggagaatcagaagctgctgtgctctgaggggtcacgtggatgtgataaggcaagctaggagcggctcctagagaaggcaacgggtgctaaatgtgcacctggcacagccctgtgcccgcgaaggttgttcagtgctggctgatgaacatgtcccagcacggctggcattgacaactcacagatctagagcaaaaccaacatgcacttgtagatgatatttcctacttctctgctatctgtagggatccttgcctgtccattttctagctctggtgcagtcatgctgctgctgctttagtagacactcacgtcatagtcttcagtgaggagatagtcttctgtgatgtgggggctgagcagtgtgtagcccactaggtagaaaaggcccagactcaggcgcttgagagcaggaatgatgctggaaaggaacgagtgaagttcctggtcacagagagcagagactattcccttcaccctctgaccttcagttatggagaggagtgtttaggggtgtggttgtctacctggaatgggatgagaagctctgctgcccaaagtgtttcctgtttcagggaaagatttctatggctggctatgaggaatggggactgcaaacctcttaagagttgtaggaaagtcagggcagcagacagtggaccagtcttgtgtttacccctcagggatgctactgatctcaaggtcttgccaggtctcacaatctccattgggactgaaaacccagtggaggtaagataataaaaataaccactttgaatctgc

SEQ ID NO: 129616 - DNA, 616 bp, Homo sapiens
  Payload ID: 5347
  Gene Symbol: EMG1
  Gene Name: EMG1 N1-specific pseudouridine methyltransferase
  ENST ID: ENST00000539196
  CDS Start-End: 1-448
gctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatggttcaacttttacacaagctcagtgttcgagcagctgatggcccccagaagcttttgaaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaa

SEQ ID NO: 129617 - DNA, 2173 bp, Homo sapiens
  Payload ID: 5348
  Gene Symbol: EMID1
  Gene Name: EMI domain containing 1
  Uniprot ID: Q96A84
  ENST ID: ENST00000334018
  CDS Start-End: 189-1520
gggccgggcgaggccgggagcgcgcgcccccgcccccgcccgcccgcctcctgcccgccctccggccgcggagctggaaaccgggctccgcgcgtccggggcggctggcggcgcgggcaggcaggcggggaggacaggctgggggcggcgaccgcgaggggccgcgcgcggagggcgcctggtgcagcatgggcggcccgcgggcttgggcgctgctctgcctcgggctcctgctcccgggaggcggcgctgcgtggagcatcggggcagctccgttctccggacgcaggaactggtgctcctatgtggtgacccgcaccatctcatgccatgtgcagaatggcacctaccttcagcgagtgctgcagaactgcccctggcccatgagctgtccggggagcagctacagaactgtggtgagacccacatacaaggtgatgtacaagatagtgaccgcccgtgagtggaggtgctgccctgggcactcaggagtgagctgcgaggaagttgcagcttcctctgcctccttggagcccatgtggtcgggcagtaccatgcggcggatggcgcttcggcccacagccttctcaggttgtctcaactgcagcaaagtgtcagagctgacagagcggctgaaggtgctggaggccaagatgaccatgctgactgtcatagagcagccagtacctccaacaccagctacccctgaggaccctgccccgctctggggtccccctcctgcccagggcagccccggagatggaggcctccaggaccaagtcggtgcttgggggcttcccgggcccaccggccccaagggagatgccggcagtcggggcccaatggggatgagaggcccaccaggtccacagggccccccagggagccctggccgggctggagctgtgggcacccctggagagaggggacctcctgggccaccagggcctcctggcccccctgggcccccagcccctgttgggccaccccatgcccggatctcccagcatggagacccattgctgtccaacaccttcactgagaccaacaaccactggccccagggacccactgggcctccaggccctccagggcccatgggtccccctgggcctcctggccccacaggtgtccctgggagtcctggtcacataggacccccaggccccactggacccaaaggaatctctggccacccaggagagaagggcgagagaggactgcgtggggagcctggcccccaaggctctgctgggcagcggggggaacctggccctaagggagaccctggtgagaagagccactggggggaggggttgcaccagctacgcgaggctttgaagattttagctgagagggttttaatcttggaaacaatgattgggctctatgaaccagagctggggtctggggcgggccctgccggcacaggcacccccagcctccttcggggcaagaggggcggacatgcaaccaactaccggatcgtggcccccaggagccgggacgagagaggctgagggtggtggcggcccctgaggcagaccaggccaggcttcccctcctacctggactcggccagctgcctccagggaccgcccgtccatatttattaatgtcctcagggtcccttctgccatctaggccttaggggtaagcaggtctcagtcctggcaccatgcacatgtctgaggctgagcaagggctgagaggagaggcttgggcctcagtttccctctgtgaagtggggggaggcaggccttcaaggagggatagaggtacaaggcttcgtctcatctgctgtctgagcatccaggcccaaaggcactgagggagtcaggagctggggctcggcacatgcagagatgacagggcagggggcagtcttcctccccctccccgaccaaacctcggggagccctcctgtgcccctccctccttgttgtccagtgctgggctccccaccccgaggtcaggctgcccaatcctctgactggatcaccgggggcttcttgcctcagttcttccctctgagcccccaggccctcccgcatctcaggttggggatggggacatggagaggaaggggccgcctactcctgcaaatgcttgtgacagatgccaggaggtagatgtgtgctggccaataaaggcccctacctgattccccgca

SEQ ID NO: 129618 - DNA, 2118 bp, Homo sapiens
  Payload ID: 5348
  Gene Symbol: EMID1
  Gene Name: EMI domain containing 1
  ENST ID: ENST00000404820
  CDS Start-End: 128-1465
ccggccgcggagctggaaaccgggctccgcgcgtccggggcggctggcggcgcgggcaggcaggcggggaggacaggctgggggcggcgaccgcgaggggccgcgcgcggagggcgcctggtgcagcatgggcggcccgcgggcttgggcgctgctctgcctcgggctcctgctcccgggaggcggcgctgcgtggagcatcggggcagctccgttctccggacgcaggaactggtgctcctatgtggtgacccgcaccatctcatgccatgtgcagaatggcacctaccttcagcgagtgctgcagaactgcccctggcccatgagctgtccggggagcagctacagaactgtggtgagacccacatacaaggtgatgtacaagatagtgaccgcccgtgagtggaggtgctgccctgggcactcaggagtgagctgcgaggaagttgcagcttcctctgcctccttggagcccatgtggtcgggcagtaccatgcggcggatggcgcttcggcccacagccttctcaggttgtctcaactgcagcaaagtgtcagagctgacagagcggctgaaggtgctggaggccaagatgaccatgctgactgtcatagagcagccagtacctccaacaccagctacccctgaggaccctgccccgctctggggtccccctcctgcccagggcagccccggagatggaggcctccaggaccaagtcggtgcttgggggcttcccgggcccaccggccccaagggagatgccggcagtcggggcccaatggggatgagaggcccaccaggtccacagggccccccagggagccctggccgggctggagctgtgggcacccctggagagaggggacctcctgggccaccagggcctcctggcccccctgggcccccagcccctgttgggccaccccatgcccggatctcccagcatggagacccattgctgtccaacaccttcactgagaccaacaaccactggccccagggacccactgggcctccaggccctccagggcccatgggtccccctgggcctcctggccccacaggtgtccctgggagtcctggtcacataggacccccaggccccactggacccaaaggaatctctggccacccaggagagaagggcgagagaggactgcgtggggagcctggcccccaaggctctgctgggcagcggggggaacctggccctaagggagaccctggtgagaagagccactgggctcctagcttacagagcttcctgcagcagcaggctcagctggagctcctggccagacgggtcaccctcctggaagccatcatctggccagaaccagagctggggtctggggcgggccctgccggcacaggcacccccagcctccttcggggcaagaggggcggacatgcaaccaactaccggatcgtggcccccaggagccgggacgagagaggctgagggtggtggcggcccctgaggcagaccaggccaggcttcccctcctacctggactcggccagctgcctccagggaccgcccgtccatatttattaatgtcctcagggtcccttctgccatctaggccttaggggtaagcaggtctcagtcctggcaccatgcacatgtctgaggctgagcaagggctgagaggagaggcttgggcctcagtttccctctgtgaagtggggggaggcaggccttcaaggagggatagaggtacaaggcttcgtctcatctgctgtctgagcatccaggcccaaaggcactgagggagtcaggagctggggctcggcacatgcagagatgacagggcagggggcagtcttcctccccctccccgaccaaacctcggggagccctcctgtgcccctccctccttgttgtccagtgctgggctccccaccccgaggtcaggctgcccaatcctctgactggatcaccgggggcttcttgcctcagttcttccctctgagcccccaggccctcccgcatctcaggttggggatggggacatggagaggaaggggccgcctactcctgcaaatgcttgtgacagatgccaggaggtagatgtgtgctggccaataaaggcccctacctgattccccgca

SEQ ID NO: 129619 - DNA, 2049 bp, Homo sapiens
  Payload ID: 5348
  Gene Symbol: EMID1
  Gene Name: EMI domain containing 1
  ENST ID: ENST00000404755
  CDS Start-End: 128-1396
ccggccgcggagctggaaaccgggctccgcgcgtccggggcggctggcggcgcgggcaggcaggcggggaggacaggctgggggcggcgaccgcgaggggccgcgcgcggagggcgcctggtgcagcatgggcggcccgcgggcttgggcgctgctctgcctcgggctcctgctcccgggaggcggcgctgcgtggagcatcggggcagctccgttctccggacgcaggaactggtgctcctatgtggtgacccgcaccatctcatgccatgtgcagaatggcacctaccttcagcgagtgctgcagaactgcccctggcccatgagctgtccggggagcagctacagaactgtggtgagacccacatacaaggtgatgtacaagatagtgaccgcccgtgagtggaggtgctgccctgggcactcaggagtgagctgcgaggaagttgcagcttcctctgcctccttggagcccatgtggtcgggcagtaccatgcggcggatggcgcttcggcccacagccttctcaggttgtctcaactgcagcaaagtgtcagagctgacagagcggctgaaggtgctggaggccaagatgaccatgctgactgtcatagagcagccagtacctccaacaccagctacccctgaggaccctgccccgctctggggtccccctcctgcccagggcagccccggagatggaggcctccaggaccaagtcggtgcttgggggcttcccgggcccaccggccccaagggagatgccggcagtcggggcccaatggggatgagaggcccaccaggtccacagggccccccagggagccctggccgggctggagctgtgggcacccctggagagaggggacctcctgggccaccagggcctcctggcccccctgggcccccagcccctgttgggccaccccatgcccggatctcccagcatggagacccattgctgtccaacaccttcactgagaccaacaaccactggccccagggacccactgggcctccaggccctccagggcccatgggtccccctgggcctcctggccccacaggtgtccctgggagtcctggtcacataggactgcgtggggagcctggcccccaaggctctgctgggcagcggggggaacctggccctaagggagaccctggtgagaagagccactggggggaggggttgcaccagctacgcgaggctttgaagattttagctgagagggttttaatcttggaaacaatgattgggctctatgaaccagagctggggtctggggcgggccctgccggcacaggcacccccagcctccttcggggcaagaggggcggacatgcaaccaactaccggatcgtggcccccaggagccgggacgagagaggctgagggtggtggcggcccctgaggcagaccaggccaggcttcccctcctacctggactcggccagctgcctccagggaccgcccgtccatatttattaatgtcctcagggtcccttctgccatctaggccttaggggtaagcaggtctcagtcctggcaccatgcacatgtctgaggctgagcaagggctgagaggagaggcttgggcctcagtttccctctgtgaagtggggggaggcaggccttcaaggagggatagaggtacaaggcttcgtctcatctgctgtctgagcatccaggcccaaaggcactgagggagtcaggagctggggctcggcacatgcagagatgacagggcagggggcagtcttcctccccctccccgaccaaacctcggggagccctcctgtgcccctccctccttgttgtccagtgctgggctccccaccccgaggtcaggctgcccaatcctctgactggatcaccgggggcttcttgcctcagttcttccctctgagcccccaggccctcccgcatctcaggttggggatggggacatggagaggaaggggccgcctactcctgcaaatgcttgtgacagatgccaggaggtagatgtgtgctggccaataaaggcccctacctgattccccgca

SEQ ID NO: 129620 - DNA, 641 bp, Homo sapiens
  Payload ID: 5348
  Gene Symbol: EMID1
  Gene Name: EMI domain containing 1
  ENST ID: ENST00000430127
  CDS Start-End: 117-641
gctggaaaccgggctccgcgcgtccggggcggctggcggcgcgggcaggcaggcggggaggacaggctgggggcggcgaccgcgaggggccgcgcgcggagggcgcctggtgcagcatgggcggcccgcgggcttgggcgctgctctgcctcgggctcctgctcccgggaggcggcgctgcgtggagcatcggggcagctccgttctccggacgcaggaactggtgctcctatgtggtgacccgcaccatctcatgccatgtgcagaatggcacctaccttcagcgagtgctgcagaactgcccctggcccatgagctgtccggggagcagctacagaactgtggtgagacccacatacaaggtgatgtacaagatagtgaccgcccgtgagtggaggtgctgccctgggcactcaggagtgagctgcgaggaaggttgtctcaactgcagcaaagtgtcagagctgacagagcggctgaaggtgctggaggccaagatgaccatgctgactgtcatagagcagccagtacctccaacaccagctacccctgaggaccctgccccgctctggggtccccctcctgcccagggcagccccggagatggaggcctccaggaccaagtcggtgcttgggggctt

SEQ ID NO: 129621 - DNA, 482 bp, Homo sapiens
  Payload ID: 5348
  Gene Symbol: EMID1
  Gene Name: EMI domain containing 1
  ENST ID: ENST00000435427
  CDS Start-End: 81-185
cggcgcgggcaggcaggcggggaggacaggctgggggcggcgaccgcgaggggccgcgcgcggagggcgcctggtgcagcatgggcggcccgcgggcttgggcgctgctctgcctcgggctcctgctcccgggaggcggcgctgcgtggagcatcggggcagctccgttctccggacgcagatgaccatgctgactgtcatagagcagccagtacctccaacaccagctacccctgaggaccctgccccgctctggggtccccctcctgcccagggcagccccggagatggaggcctccaggaccaagtcggtgcttgggggcttcccgggcccaccggccccaagggagatgccggcagtcggggcccaatggggatgagaggcccaccaggtccacagggccccccagggagccctggccgggctggagctgtgggcacccctggagagaggggacctcctgggccaccagggcctcctg

SEQ ID NO: 129622 - DNA, 769 bp, Homo sapiens
  Payload ID: 5348
  Gene Symbol: EMID1
  Gene Name: EMI domain containing 1
  ENST ID: ENST00000429226
  CDS Start-End: 134-769
cgccctccggccgcggagctggaaaccgggctccgcgcgtccggggcggctggcggcgcgggcaggcaggcggggaggacaggctgggggcggcgaccgcgaggggccgcgcgcggagggcgcctggtgcagcatgggcggcccgcgggcttgggcgctgctctgcctcgggctcctgctcccgggaggcggcgctgcgtggagcatcggggcagctccgttctccggacgcaggaactggtgctcctatgtggtgacccgcaccatctcatgccatgtgcagaatggcacctaccttcagcgagtgctgcagaactgcccctggcccatgagctgtccggggagcagctacagaactgtggtgagacccacatacaaggtgatgtacaagatagtgaccgcccgtgagtggaggtgctgccctgggcactcaggagtgagctgcgaggaagttgcagcttcctctgcctccttggagcccatgtggtcgggcagtaccatgcggcggatggcgcttcggcccacagccttctcaggttgtctcaactgcagcaaagtgtcagagctgacagagcggctgaaggtgctggaggccaagatgaccatgctgactgtcatagagcagccagtacctccaacaccagctacccctgaggaccctgccccgctctggggtccccctcctgcccagggcagccccggagatggaggcctccagggagacccattgctgtccaacaccttcactgagaccaacaaccactggccc

SEQ ID NO: 129623 - DNA, 707 bp, Homo sapiens
  Payload ID: 5348
  Gene Symbol: EMID1
  Gene Name: EMI domain containing 1
  ENST ID: ENST00000433143
  CDS Start-End: 1-707
agatgaccatgctgactgtcatagagcagccagtacctccaacaccagctacccctgaggaccctgccccgctctggggtccccctcctgcccagggcagccccggagatggaggcctccaggggctgccaggagccatagagagtgtgagggtcccgctgcttccccgaaatgaccaagtcggtgcttgggggcttcccgggcccaccggccccaagggagatgccggcagtcggggcccaatggggatgagaggcccaccaggtccacagggccccccagggagccctggccgggctggagctgtgggcacccctggagagaggggacctcctgggccaccagggcctcctggcccccctgggcccccagcccctgttgggccaccccatgcccggatctcccagcatggagacccattgctgtccaacaccttcactgagaccaacaaccactggccccagggacccactgggcctccaggccctccagggcccatgggtccccctgggcctcctggccccacaggtgtccctgggagtcctggtcacataggacccccaggccccactggacccaaaggaatctctggccacccaggagagaagggcgagagaggactgcgtggggagcctggcccccaaggctctgctgggcagcggggggaacctggccctaagggagaccctggtgagaagagccactgg

SEQ ID NO: 129624 - DNA, 714 bp, Homo sapiens
  Payload ID: 5349
  Gene Symbol: EBP
  Gene Name: emopamil binding protein (sterol isomerase)
  ENST ID: ENST00000446158
  CDS Start-End: 234-714
cctaaagagagcccggagccagcgtgggaggccgctgccgtcgcgcgccttgcgctgcacgccagacaccggcctttcaatatccgtctcttccctgcaggttgacggcgttgcacgctctcgcggggaggctctggctttccaaacgctggcaccgagggtttttctgttccttttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctggaaagagtatgccaagggagacagccgatacatcctgggtgacaacttcacagtgtgcatggaaaccatcacagcttgcctgtggggaccactcagcctgtgggtggtgatcgcctttctccgccagcatcccctccgcttcattctacagcttgtggtctctgtgggccagatctatg

SEQ ID NO: 129625 - DNA, 609 bp, Homo sapiens
  Payload ID: 5349
  Gene Symbol: EBP
  Gene Name: emopamil binding protein (sterol isomerase)
  ENST ID: ENST00000414061
  CDS Start-End: 173-609
cggagccagcgtgggaggccgctgccgtcgcgcgccttggttgacggcgttgcacgctctcgcggggaggctctggctttccaaacgctggcaccgagggtttttctgttccttttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctggaaagagtatgccaagggagacagccgatacatcctgggtgacaacttcacagtgtgcatggaaaccatcacagcttgcctgtggggaccactcagcctgtgggtggtgatcgcctttctccgccagcatcccct

SEQ ID NO: 129626 - DNA, 1775 bp, Homo sapiens
  Payload ID: 5349
  Gene Symbol: EBP
  Gene Name: emopamil binding protein (sterol isomerase)
  Uniprot ID: Q15125
  ENST ID: ENST00000495186
  CDS Start-End: 824-1516
tctaattggatgggaggtctgggatgggtctggattctgattgattgctccatctgggggcccactggtggttaggcgtttgattggctttttagaactggcatatggagattgagggtcttcatgccaattggtcagtaggactgagaggcctgggttctaactagttcttctgacttgaggtcgggagaagagagaatgaccgctgctattaggactgaggagttctgagcactgaagagctggggagggggtggttgcagtgtatagcgtgtgatctgcttgtaacagtttcgttgcattatactaagggttactctacctagaaaagggcggaggtgaaaggatgcaacgcaacgctaatttcaccagcggaagaagcgggtacagaccttaatgagtccccgttttgatcgactgataagggaatggggaaattgaagccaggactcgatgcagattggctacggatccaaaacgcccactaaccttggcgcgtcccagtctccaccccaaacctaactcaggtgaaaatggcgccacgcgcgggggcggggctagaggtacaaagagagtgtctattggttgggagcggcacgggccgccttcttcgcttcaccattggctcgctccgtaaggcaagagaacccactaggggatgagcccgaactagggatgtgacagagcgcgagacccagcctaaagagagcccggagccagcgtgggaggccgctgccgtcgcgcgccttggtttttctgttccttttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctggaaagagtatgccaagggagacagccgatacatcctgggtgacaacttcacagtgtgcatggaaaccatcacagcttgcctgtggggaccactcagcctgtgggtggtgatcgcctttctccgccagcatcccctccgcttcattctacagcttgtggtctctgtgggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaa

SEQ ID NO: 129627 - DNA, 914 bp, Homo sapiens
  Payload ID: 5350
  Gene Symbol: EBPL
  Gene Name: emopamil binding protein-like
  Uniprot ID: Q9BY08
  ENST ID: ENST00000242827
  CDS Start-End: 52-672
tgctttcctctgccgcatggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggaaggcccttttgtctacttgtctttagtaggaaacgttgcaaattccgatggcttgattgcttctttatggaaagaatatggcaaagctgatgcaagatgggtttattttgatccaaccattgtgtctgtggaaattctgaccgtcgccctggatgggtctctggcattgttcctcatttatgccatagtcaaagaaaaatattaccggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattataca

SEQ ID NO: 129628 - DNA, 680 bp, Homo sapiens
  Payload ID: 5350
  Gene Symbol: EBPL
  Gene Name: emopamil binding protein-like
  Uniprot ID: Q9BY08
  ENST ID: ENST00000378268
  CDS Start-End: 40-498
ccgcatggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggaaggcccttttgtctacttgtctttagtaggaaacgttgcaaattccgatggcttgattgcttctttatgcgagtctcgctctgtcccccaggctggagcacagtggcaccatctcggctcactgcaagctccgcctcccaggttcacgccattctcctgcctcagcctcccgagtagctgggactacaggcgcccgccaccacgcctagctaatttttttgtatttttagtagagacggggtttcaccatgttagccaggatggtctcgatctcctgacctcgtgatctgcccacctcggcctcccaaagtgctggggttataggcatgagccaccgcgcctggcccatatatctcatttctttgtgactctaaaatcatctccagctaggatctgtgtgggggactcctgtttaccactagtgttaggaaacatctagagaattgagtaggctcattagtacttccc

SEQ ID NO: 129629 - DNA, 579 bp, Homo sapiens
  Payload ID: 5350
  Gene Symbol: EBPL
  Gene Name: emopamil binding protein-like
  Uniprot ID: Q9BY08
  ENST ID: ENST00000378270
  CDS Start-End: 34-342
ggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaa

SEQ ID NO: 129630 - DNA, 766 bp, Homo sapiens
  Payload ID: 5350
  Gene Symbol: EBPL
  Gene Name: emopamil binding protein-like
  Uniprot ID: Q9BY08
  ENST ID: ENST00000378272
  CDS Start-End: 40-333
ccgcatggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggaaggcccttttgtctacttgtctttagtaggaaacgttgcaaattccgatggcttgattgcttctttatgcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattatacattt

SEQ ID NO: 129631 - DNA, 967 bp, Homo sapiens
  Payload ID: 5350
  Gene Symbol: EBPL
  Gene Name: emopamil binding protein-like
  ENST ID: ENST00000378284
  CDS Start-End: 40-444
ccgcatggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggaaggcccttttgtctacttgtctttagtaggaaacgttgcaaattccgatggcttgattgcttctttatggaaagaatatggcaaagctgatgcaagatgggtttattttgatccaaccattgtgtctgtggaaattctgaccgtcgccctggatgggtctctggcattgttcctcatttatgccatagtcaaagaaaaatattaccgggacagagtggcctggggtgaatagattgctatcctgagatgaatccctaaaacaatttcaagcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattatacattt

SEQ ID NO: 129632 - DNA, 2188 bp, Homo sapiens
  Payload ID: 5351
  Gene Symbol: EMX1
  Gene Name: empty spiracles homeobox 1
  Uniprot ID: Q04741
  ENST ID: ENST00000258106
  CDS Start-End: 379-1251
aggtgagcggcggccaatgggcgagcgcggggcaggtgcccgctaactcgcgcctcgcagcgctgggcggccggggctgggcagggcagtgcggggacaccgggggctggggtcggtcccagcgggactccgaaaggagggagacgagctcaaccctcgggccttactggcagctcgcagcctagcacggagcccgcgcctgtgcgggcgcctggagctgcccgctccgccgcagcagccgccgcgcctggccgtacgctgtggccggaccccgcggtcgctcgctcacacacccctcgccgctccgcgcctggctcgcccgcgggggccgagcgcgagcgggcgggcgggggaggtgaggggtgcgggcgggtgtgcatgtgcctggctgggtgcacaccccgcaaggcggcggcgccaggacgcggagcgctccccagagcccggctgcctcgcacagctcccgcggctgcgaccatgttccagcccgcggccaagcgcggctttaccatagagtccttggtggccaaggacggcggcaccggcgggggcactggcggcgggggcgcgggctcccatctcctggcggcggccgcctccgaggaaccgctccggcccacggcgctcaactaccctcaccccagcgcggccgaggcggccttcgtgagtggcttccctgccgcggccgccgcgggcgcgggccgctcgctctacggtgggcccgagctcgtgttccccgaggccatgaaccaccccgcgctgaccgtgcatccggcgcaccagctgggcgcctccccgctgcagcccccgcactccttcttcggcgcccagcaccgggaccctctccatttctacccctgggtcctgcggaaccgcttcttcggccaccgcttccaggccagcgacgtgccccaggacgggctgcttctgcacggccccttcgcacgcaagcccaagcggatccgcacggccttctcgccctcgcagctgctgcggctggagcgcgccttcgagaagaaccactacgtggtgggcgccgagcggaagcagctggccggcagtctcagcctctccgagacgcaggtgaaggtgtggttccagaaccggaggacaaagtacaaacggcagaagctggaggaggaagggcctgagtccgagcagaagaagaagggctcccatcacatcaaccggtggcgcattgccacgaagcaggccaatggggaggacatcgatgtcacctccaatgactagggtgggcaaccacaaacccacgagggcagagtgctgcttgctgctggccaggcccctgcgtgggcccaagctggactctggccactccctggccaggctttggggaggcctggagtcatggccccacagggcttgaagcccggggccgccattgacagagggacaagcaatgggctggctgaggcctgggaccacttggccttctcctcggagagcctgcctgcctgggcgggcccgcccgccaccgcagcctcccagctgctctccgtgtctccaatctcccttttgttttgatgcatttctgttttaatttattttccaggcaccactgtagtttagtgatccccagtgtcccccttccctatgggaataataaaagtctctctcttaatgacacgggcatccagctccagccccagagcctggggtggtagattccggctctgagggccagtgggggctggtagagcaaacgcgttcagggcctgggagcctggggtggggtactggtggagggggtcaagggtaattcattaactcctctcttttgttgggggaccctggtctctacctccagctccacagcaggagaaacaggctagacatagggaagggccatcctgtatcttgagggaggacaggcccaggtctttcttaacgtattgagaggtgggaatcaggcccaggtagttcaatgggagagggagagtgcttccctctgcctagagactctggtggcttctccagttgaggagaaaccagaggaaaggggaggattggggtctgggggagggaacaccattcacaaaggctgacggttccagtccgaagtcgtgggcccaccaggatgctcacctgtccttggagaaccgctgggcaggttgagactgcagagacagggcttaaggctgagcctgcaaccagtccccagtgactc

SEQ ID NO: 129633 - DNA, 480 bp, Homo sapiens
  Payload ID: 5351
  Gene Symbol: EMX1
  Gene Name: empty spiracles homeobox 1
  ENST ID: ENST00000473732
  CDS Start-End: 39-480
cgctctacggtgggcccgagctcgtgttccccgaggccatgaaccaccccgcgctgaccgtgcatccggcgcaccagctgggcgcctccccgctgcagcccccgcactccttcttcggcgcccagcaccgggaccctctccatttctacccctgggtcctgcggaaccgcttcttcggccaccgcttccaggccagcgacgtgccccaggacgggctgcttctgcacggccccttcgcacgcaagcccaagcggatccgcacggccttctcgccctcgcagctgctgcggctggagcgcgccttcgagaagaaccactacgtggtgggcgccgagcggaagcagctggccggcagtctcagcctctccgagacgcaggtccgacgtgttggagtggggctcagcgaccctcagcctagctgctgccctggaggtggatttcagtctctgcgtgccggccggctcccagagttgcgagagg

SEQ ID NO: 129634 - DNA, 1528 bp, Homo sapiens
  Payload ID: 5351
  Gene Symbol: EMX1
  Gene Name: empty spiracles homeobox 1
  ENST ID: ENST00000394111
  CDS Start-End: 425-1054
gagttgcgcggcgcacggaccccgtggccttggggcgtcaggaggcccaacccagatctgcgcgcccaggcagcgctcaggccgctagaatggaccccggcagcggcgaggaagcggaactctctgcggctccctctccgcagtgcgccggcaaggtccaggtcccagcctccccaccgccgcccgcgccctcctaggcctcggagcggcgcctttctgcggcctcgaaggtggggtgggaaagtttggggagtcccggctctcacagcctgtcgtgagaactgcccccggggaattcgtccgccgtacggaaaaactggccggagcagagtcgtccgcggttccgcggtcgcgggtggaaggtgaaggtcgagggaggtcaggctgcttctgcgtgtcctgacggctggcgtgttctcttgagatgggctcgggctacttggccagcttcaatttaagccacagtgtctccgaggccctgacctggtccggcccgccgacacttgagcccccagagcctcagagaaggcgagggggtggatctcccagtgccgaggcccgccgtcctggtccaagccggtcgcggcaccgtgtctgggcactggagctgcttccagccccgcgaacagctggagggtggcagtgggaccgctccggcggcttctcccgcgcagtgccccgcctggccccttgtgaagggagtgagcgtcccctttccagagctgtcccccgtgacatccagaaaacgcgaaacctcaggaacaaggtcgcagcttcagaccgcggcccaggaggccgatgccagcgacgtgccccaggacgggctgcttctgcacggccccttcgcacgcaagcccaagcggatccgcacggccttctcgccctcgcagctgctgcggctggagcgcgccttcgagaagaaccactacgtggtgggcgccgagcggaagcagctggccggcagtctcagcctctccgagacgcaggtgaaggtgtggttccagaaccggaggacaaagtacaaacggcagaagctggaggaggaagggcctgagtccgagcagaagaagaagggctcccatcacatcaaccggtggcgcattgccacgaagcaggccaatggggaggacatcgatgtcacctccaatgactagggtgggcaaccacaaacccacgagggcagagtgctgcttgctgctggccaggcccctgcgtgggcccaagctggactctggccactccctggccaggctttggggaggcctggagtcatggccccacagggcttgaagcccggggccgccattgacagagggacaagcaatgggctggctgaggcctgggaccacttggccttctcctcggagagcctgcctgcctgggcgggcccgcccgccaccgcagcctcccagctgctctccgtgtctccaatctcccttttgttttgatgcatttctgttttaatttattttccaggcaccactgtagtttagtgatccccagtgtcccccttccctatgggaataat

SEQ ID NO: 129635 - DNA, 2897 bp, Homo sapiens
  Payload ID: 5352
  Gene Symbol: EMX2
  Gene Name: empty spiracles homeobox 2
  Uniprot ID: Q04743
  ENST ID: ENST00000553456
  CDS Start-End: 825-1583
gcgggcgccgcaggagcgagtgagctgggagcgaggggcgaaggcgcggagaagcccggccgcccggtgggcggcagaaggctcagccgaggcggcggcgccgactccgttccactctcggcccggatccaggcctccgggttcccaggcgctcacctccctctgacgcactttaaagagtctccccccttccacctcagggcgagtaatagcgaccaatcatcaagccatttaccaggcttcggaggaagctgtttatgtgatccccgcactaattaggctcatgaactaacaaatcgtttgcacaacttgtgaagaagcgaacacttccatggattgtccttggacttagggcgccctgcccgccttttgcagaggagaaaaaacttttttttttttttgcctcccccgagaactttccccccttctcctccctgcctctaactccgatccccccacgccatctcgccaaaaaaaaaaaaaaaaaaaaaaaagaaaaaaaaagaaaaaaaaagaaaaaaaattaccccaatccacgcctgcaaattcttctggaaggattttcccccctctcttcaggttgggcgcgtttggtgcaagattctcgggatcctcggctttgcctctccctctccctcccccctcctttcctttttcctttcctttcctttctttcttcctttccttccccccacccccacccccaccccaaacaaacgagtccccaattctcgtccgtcctcgccgcgggcagcgggcggcggaggcagcgtgcggcggtcgccaggagctgggagcccagggcgcccgctcctcggcgcagcatgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcactcgccacaccccctattcgcctcgcagcagcgggatccgtccaccttctacccctggctcatccaccgctaccgatatctgggtcatcgcttccaagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccgaaaggaagcagctggcacacagcctcagcctcacggaaactcaggtaaaagtatggtttcagaaccgaagaacaaagttcaaaaggcagaagctggaggaagaaggctcagattcgcaacaaaagaaaaaagggacgcaccatattaaccggtggagaatcgccaccaagcaggcgagtccggaggaaatagacgtgacctcagatgattaaaaacataaacctaaccccacagaaacggacaacatggagcaaaagagacagggagaggtggagaaggaaaaaaccctacaaaacaaaaacaaaccgcatacacgttcaccgagaaagggagagggaatcggagggagcagcggaatgcggcgaagactctggacagcgagggcacagggtcccaaaccgaggccgcgccaagatggcagaggatggaggctccttcatcaacaagcgaccctcgtctaaagaggcagctgagtgagagacacagagagaaggagaaagagggagggagagagagaaagagagagaaagagagagagagagagagagagagaaagctgaacgtgcactctgacaaggggagctgtcaatcaaacaccaaaccggggagacaagatgattggcaggtattccgtttatcacagtccacttaaaaaatgatgatgatgataaaaaccacgacccaaccaggcacaggacttttttgttttttgcacttcgctgtgtttcccccccatctttaaaaataattagtaataaaaaacaaaaattccatatctagccccatcccacacctgtttcaaatccttgaaatgcatgtagcagttgttgggcgaatggtgtttaaagaccgaaaatgaattgtaattttcttttccttttaaagacaggttctgtgtgctttttattttgattttttttcccaagaaatgtgcagtctgtaaacactttttgataccttctgatgtcaaagtgattgtgcaagctaaatgaagtaggctcagcgatagtggtcctcttacagagaaacggggagcaggacgacgggggggctgggggtggcgggggagggtgcccacaaaaagaatcaggacttgtactgggaaaaaaacccctaaattaattatatttcttggacattccctttcctaacatcctgaggcttaaaaccctgatgcaaacttctcctttcagtggttggagaaattggccgagttcaaccattcactgcaatgcctattccaaactttaaatctatctattgcaaaacctgaaggactgtagttagcggggatgatgttaagtgtggccaagcgcacggcggcaagttttcaagcactgagtttctattccaagatcatagacttactaaagagagtgacaaatgcttccttaatgtcttctataccagaatgtaaatatttttgtgttttgtgttaatttgttagaattctaacacactatatacttccaagaagtatgtcaatgtcaatattttgtcaataaagatttatcaatatgccctca

SEQ ID NO: 129636 - DNA, 2710 bp, Homo sapiens
  Payload ID: 5352
  Gene Symbol: EMX2
  Gene Name: empty spiracles homeobox 2
  Uniprot ID: Q04743
  ENST ID: ENST00000442245
  CDS Start-End: 824-1333
cgggcgccgcaggagcgagtgagctgggagcgaggggcgaaggcgcggagaagcccggccgcccggtgggcggcagaaggctcagccgaggcggcggcgccgactccgttccactctcggcccggatccaggcctccgggttcccaggcgctcacctccctctgacgcactttaaagagtctccccccttccacctcagggcgagtaatagcgaccaatcatcaagccatttaccaggcttcggaggaagctgtttatgtgatccccgcactaattaggctcatgaactaacaaatcgtttgcacaacttgtgaagaagcgaacacttccatggattgtccttggacttagggcgccctgcccgccttttgcagaggagaaaaaacttttttttttttttgcctcccccgagaactttccccccttctcctccctgcctctaactccgatccccccacgccatctcgccaaaaaaaaaaaaaaaaaaaaaaaagaaaaaaaaagaaaaaaaaagaaaaaaaattaccccaatccacgcctgcaaattcttctggaaggattttcccccctctcttcaggttgggcgcgtttggtgcaagattctcgggatcctcggctttgcctctccctctccctcccccctcctttcctttttcctttcctttcctttctttcttcctttccttccccccacccccacccccaccccaaacaaacgagtccccaattctcgtccgtcctcgccgcgggcagcgggcggcggaggcagcgtgcggcggtcgccaggagctgggagcccagggcgcccgctcctcggcgcagcatgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcactcgccacaccccctattcgcctcgcagcagcgggatccgtccaccttctacccctggctcatccaccgctaccgatatctgggtcatcgcttccaaggtaaaagtatggtttcagaaccgaagaacaaagttcaaaaggcagaagctggaggaagaaggctcagattcgcaacaaaagaaaaaagggacgcaccatattaaccggtggagaatcgccaccaagcaggcgagtccggaggaaatagacgtgacctcagatgattaaaaacataaacctaaccccacagaaacggacaacatggagcaaaagagacagggagaggtggagaaggaaaaaaccctacaaaacaaaaacaaaccgcatacacgttcaccgagaaagggagagggaatcggagggagcagcggaatgcggcgaagactctggacagcgagggcacagggtcccaaaccgaggccgcgccaagatggcagaggatggaggctccttcatcaacaagcgaccctcgtctaaagaggcagctgagtgagagacacagagagaaggagaaagagggagggagagagagaaagagagagaaagagagagagagagagagagagagaaagctgaacgtgcactctgacaaggggagctgtcaatcaaacaccaaaccggggagacaagatgattggcaggtattccgtttatcacagtccacttaaaaaatgatgatgatgataaaaaccacgacccaaccaggcacaggacttttttgttttttgcacttcgctgtgtttcccccccatctttaaaaataattagtaataaaaaacaaaaattccatatctagccccatcccacacctgtttcaaatccttgaaatgcatgtagcagttgttgggcgaatggtgtttaaagaccgaaaatgaattgtaattttcttttccttttaaagacaggttctgtgtgctttttattttgattttttttcccaagaaatgtgcagtctgtaaacactttttgataccttctgatgtcaaagtgattgtgcaagctaaatgaagtaggctcagcgatagtggtcctcttacagagaaacggggagcaggacgacgggggggctgggggtggcgggggagggtgcccacaaaaagaatcaggacttgtactgggaaaaaaacccctaaattaattatatttcttggacattccctttcctaacatcctgaggcttaaaaccctgatgcaaacttctcctttcagtggttggagaaattggccgagttcaaccattcactgcaatgcctattccaaactttaaatctatctattgcaaaacctgaaggactgtagttagcggggatgatgttaagtgtggccaagcgcacggcggcaagttttcaagcactgagtttctattccaagatcatagacttactaaagagagtgacaaatgcttccttaatgtcttctataccagaatgtaaatatttttgtgttttgtgttaatttgttagaattctaacacactatatacttccaagaagtatgtcaatgtcaatattttgtcaataaagatttatcaatatgccctc

SEQ ID NO: 129637 - DNA, 1584 bp, Homo sapiens
  Payload ID: 5352
  Gene Symbol: EMX2
  Gene Name: empty spiracles homeobox 2
  ENST ID: ENST00000616794
  CDS Start-End: 1-210
tcctcgcactcgccacaccccctattcgcctcgcagcagcgggatccgtccaccttctacccctggctcatccaccgctaccgatatctgggtcatcgcttccaaggtaaaagtatggtttcagaaccgaagaacaaagttcaaaaggcagaagctggaggaagaaggctcagattcgcaacaaaagaaaaaagggacgcaccatattaaccggtggagaatcgccaccaagcaggcgagtccggaggaaatagacgtgacctcagatgattaaaaacataaacctaaccccacagaaacggacaacatggagcaaaagagacagggagaggtggagaaggaaaaaaccctacaaaacaaaaacaaaccgcatacacgttcaccgagaaagggagagggaatcggagggagcagcggaatgcggcgaagactctggacagcgagggcacagggtcccaaaccgaggccgcgccaagatggcagaggatggaggctccttcatcaacaagcgaccctcgtctaaagaggcagctgagtgagagacacagagagaaggagaaagagggagggagagagagaaagagagagaaagagagagagagagagagagagagaaagctgaacgtgcactctgacaaggggagctgtcaatcaaacaccaaaccggggagacaagatgattggcaggtattccgtttatcacagtccacttaaaaaatgatgatgatgataaaaaccacgacccaaccaggcacaggacttttttgttttttgcacttcgctgtgtttcccccccatctttaaaaataattagtaataaaaaacaaaaattccatatctagccccatcccacacctgtttcaaatccttgaaatgcatgtagcagttgttgggcgaatggtgtttaaagaccgaaaatgaattgtaattttcttttccttttaaagacaggttctgtgtgctttttattttgattttttttcccaagaaatgtgcagtctgtaaacactttttgataccttctgatgtcaaagtgattgtgcaagctaaatgaagtaggctcagcgatagtggtcctcttacagagaaacggggagcaggacgacgggggggctgggggtggcgggggagggtgcccacaaaaagaatcaggacttgtactgggaaaaaaacccctaaattaattatatttcttggacattccctttcctaacatcctgaggcttaaaaccctgatgcaaacttctcctttcagtggttggagaaattggccgagttcaaccattcactgcaatgcctattccaaactttaaatctatctattgcaaaacctgaaggactgtagttagcggggatgatgttaagtgtggccaagcgcacggcggcaagttttcaagcactgagtttctattccaagatcatagacttactaaagagagtgacaaatgcttccttaatgtcttctataccagaatgtaaatatttttgtgttttgtgttaatttgttagaattctaacacactatatacttccaagaagtatgtcaatgtcaatattttgtcaataaagatttatcaatatgcc

SEQ ID NO: 129638 - DNA, 665 bp, Homo sapiens
  Payload ID: 5353
  Gene Symbol: ENAH
  Gene Name: enabled homolog (Drosophila)
  ENST ID: ENST00000284563
  CDS Start-End: 27-665
ggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagcccagagcaaggttactgctacccaggacagcactaatttgcgatgtattttctgtgggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagag

SEQ ID NO: 129639 - DNA, 2758 bp, Homo sapiens
  Payload ID: 5353
  Gene Symbol: ENAH
  Gene Name: enabled homolog (Drosophila)
  Uniprot ID: Q8N8S7
  ENST ID: ENST00000366843
  CDS Start-End: 356-2068
cggcggccgggcgcgcggccccggcgggcacccctcagagggcggccgaggaagctccgggaggaggagcaggaccacgaggaggtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctgcccctgcctctgttgagactcctctaaactctgtgctgggagactcttctgcttctgagccaggcttgcaggcagcctctcagccggccgagactccatcccaacagggcattgtcttgggaccacttgcacctccacctcctccaccactcccaccagggcctgcacaggcttcagtagccctccctcctcccccagggccccctccacctcctccactcccatccaccgggcctccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaa

SEQ ID NO: 129640 - DNA, 13168 bp, Homo sapiens
  Payload ID: 5353
  Gene Symbol: ENAH
  Gene Name: enabled homolog (Drosophila)
  Uniprot ID: Q8N8S7
  ENST ID: ENST00000366844
  CDS Start-End: 453-2228
ggttcctcgcggcgatcccgactctcctcccgcggctgcagcagctgccggttgcacacggcctcggcggcggcgcggcgagcgcgggcctgtggagcggcggccgggcgcgcggccccggcgggcacccctcagagggcggccgaggaagctccgggaggaggagcaggaccacgaggaggtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctgcccctgcctctgttgagactcctctaaactctgtgctgggagactcttctgcttctgagccaggcttgcaggcagcctctcagccggccgagactccatcccaacagggcattgtcttgggaccacttgcacctccacctcctccaccactcccaccagggcctgcacaggcttcagtagccctccctcctcccccagggccccctccacctcctccactcccatccaccgggcctccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagacgggattctccaaggaaaaatcagattgtttttgacaacaggtcctatgattcattacacagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacacgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcaggtacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaagtccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggtaacagggagactcatttctacaaaaaaatttaaaaatttaggccaggcatggtggtgcacacctgtaatcccagctactcaggagactgaagcgggaggatcacctgagcccagggaggacgcggctgcagtgagccgttatcatgccactgtactccagcctgggtgacagagcgagaacctgtctctaaaaaaaaaaaaaaaaaattctaagagaatatagcttttcatagaaattattagaaaagcttacatatttcattagagagcccagtttgttagactacatttattccgtaaaagttctatatacaaatgacaacccatagtttatcatgtaaatctgatttaactgttcccttcaattccaagaaagatttcttcagcagtagatgacaattctaaaagcataaagaaataactaataaaggagatggatgatgttataggttggtttggttgggttttagtaaatagttattcttctaagaaggcttagaaaatcgagaattgaatagttggtactttgaattccataggaaaaagcactcagaagaaaaagtctacattggctagtgtttagattgagagttaattttcccatcaagtccaaaagtttccatccaagtctatagaaactgagagaaaaggttcttggcttacacttaaaatacacattgttgcaaccatataagagagatacattacagaacgcttttaaaaatttggtctcttaagcgcctaacagtccatgctttagtcacatctgtgaaacctcttttctttttttctttttcttttatttttttttttaaagattaaaggcattttaaaaataaatgtttcatggccgggcatggtggctcacgcctgtaatcccagcactttgggaggctgaggtgggcagatcacctgaggtcaggagtttgagaccagcctggccaacatgatgaaaccccatctctactaaaaatacaaaaaaattggctgggcatagtggtgggcacctgtaatcccagctcttcgggaggctgagacagaagagtcgcttgaatccaggaggtggaggttgcagtgagctaagaccgcgccactgtactccagcctgggcgacagagcgagattccatctctaaataaataaatgtttttcaacgtgttttatgtgagaaataccagcttttcattattactaccagttgatctcaggtgtcacttggttggttctgctgaccgaggcactgggcattttaaatatggagtttccctccacccattgatcaagtctgaggtttgtccatccttggtggcaggctagcttaaccatggattcacaaaccccatttgattgtcgtaagtcataaggccaccccagtgccagtggttgggcatcacagtgagtctgaggtgatgaatttgagttagctgtaggctagttccgcaactcagcaatagcccatggatggttggtaaaagacgttgactttgccacttaaatttccaggagaagaatagcttatagtttatctgaggaaagtaattgggaaggcttagatattgagaagaaagccctgttaaaatctaggtagcatttcctttcttctttattactagagggatgggaggttcaggcctgagtcaggactttacaatttggtgtccttcccagaggtactttgggcttgatcattttaagtttcaattgcaaaaaaaaatttttgacggagtgttgctctgtcactcaggttggagtgcagtggtgcgatctcggctcactgcaacttcccccccctgggttcaaagggattttcctgcctcagcctcccaagtagctgggactacaggcgcgtgccaccatgcccgactaatttttgtatttttagtagagatggggtttcaccatgttgcccaggctggtcttgaactcctgagctcaggtgatctgcccgcctcggccttcaattgcagaagtttttgaagggagaatatttgatcctcacataaaatgtccttgtttctgaaagaaaacatggtaaaaattgttattgagtccatgtctttgccaccttgttggacttgatttccctttctctgtgttcctcccgccctcagtctctctcagtctgtccttttttgtgtgtggagttgtgggcaggtcattggactgggactgactttaccagttttcaggctgtggggctagtcagtcattctctctgagccttctacctctaaagttgagttctttttttaaattctttttgttttgtttttattttttccttgccactatacaagcaaggatagataaagctttttattattattgttattattattatttcgagacagtctcgctctgtcatccaggctggagtgcagtggtgtgatttcagctcactgcaacctctgcctcccgggttcaagcgattctcctacctcagcctccttagtagctgggactacaggcatgcgccaccacacccggctaatttttgtatttttagtagagacagggtttcaccgtattggccaggctggtctcgaactcctgacctcaggtgatccacccaccttggcctcccaaagtgttgggattacaggcataagcgaccgtgcccatccccgataaagttgagttctgaatttcctctttcactgtattctcggcagctactggttggtttattctttttttttaatcttttttggtttattcttcttttgatctttgaagagaaggagaaaaaagatctgagtttggctctcccatcttaagtgcagcttttagttgttttatagtcatagacgctattgcactggacagcatgcatcctggatgtaaacaatgcggaaaaatcaatggagtgaccatcttggggtcagtggtgttgcataaagcaccagtggtgtgctgttctgtgtcagtttcctctgcgccacgtgctttcacagtttgaattaccagcatctctgtggtggcttcagtacattctccattgtgcttcaacctggaagcacattctgccgttcagaaagactgattccaatcatgtaatgggaccacacgagatccatgctccaattatatgaatagcagaaggtccatttgactcttgtagttcaagagctgtttctaagtaaacagactttccagagctcgatgaagtgaagaagcccttctttcaattcctgggcagaattcagtggttttcatatcatctgaacctgctgtgctgctgtttattctatcactgtcagccttgaaaggaaaaaaggaataatcttaccctcctgcccttcttattttatatcttccatcttatccatctatatccatgtagtcattccttccgagttccctggttttaatccaaaagactctgtttaacagcaatgtcttggcagaccaggtgccgcttccgtgccatttgagggctctgagtctttgcttcgtcttaggaagataaagataatttggcagaaagtcagagatggaaatagcagtttgggatgataaaagatgggtcctgttttgctgacattcttttactttggttcttggtgcgtgtcctttgggattcatttcttgctagcatgaataggacatgcttttcgttaggtgcttttcttttttggagaacatgaagtgtttctaacaaaactgaatgagctagaaagaattctattttgagacatctgtagttgatgcaaagtatttctgtaatcctcaatgacagtacttacatatttgcatagaattttttttttaatttttgaggaaacctctctggagtctgtatttataggagcatcctgaaagtccctattatgtagctggtgggagcgagagagggacagccacactcgtgctgtgagcagagcacaacttcaggcagagtgaatgccttctgagttctcattggaagctttctgttgctcagcctctggcagatttcagaaccttctacttaagccaggtgtggtggtgcgtgctcctaggcacagcgactcggggggctgaggcagaaggatcacttgagcccaaagttggaggccagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggccttgccgaattcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaa

SEQ ID NO: 129641 - DNA, 807 bp, Homo sapiens
  Payload ID: 5353
  Gene Symbol: ENAH
  Gene Name: enabled homolog (Drosophila)
  ENST ID: ENST00000497899
  CDS Start-End: 1-727
caggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctggtaagaagtttacaaactcttctgtgttcttgtatctgagcttggatgatgtctcttgtgcagtcatgtgttaaaatatttcacatttgagatgtttgggattaagccatacaatttgaaattatgaataaatatgcagcaattactactttaa

SEQ ID NO: 129642 - DNA, 3308 bp, Homo sapiens
  Payload ID: 5353
  Gene Symbol: ENAH
  Gene Name: enabled homolog (Drosophila)
  ENST ID: ENST00000635051
  CDS Start-End: 10-2418
gccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagtgttctatttagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctccatcttcagacagctccctgtataacgctccacttcctgagtattccagttgccagcctccttcagcacctcctccatcatacgctaaagtcatctcagctccagtgtcagatgccactcctgattatgctgtagtgactgctttgccacctacttccacaccccctacaccaccactgcgacactcagcgacacgttttgcaacatctttaggttcagccttccaccctgttcttccccattacgctacagttcctcgtcctctgaacaaaaactctcgaccttcttctcctgtgaacacaccctcttctcagcctccagctacgaagccctgtgcctggtctacttccaatttttcgcccctccctccatctcctccaataatgattagcagccccccaggcaaagctactggtccaaggcctgtcctccctgtttgtgtttcttctcctgtgccccaaatgcctccatcaccgacagcacccaatgggctggttgactctgtaacatatccagtgtctccaccgcctacctcagggccagcagctcctccgccgccgcctccactgccttccctcgcatcactctcacactgtggatctcaagcttctcctcctccaagcacccctattgcctcaactccctcatccaagcctagtgttctcccttctccctctgcagctgcccctgcctctgttgagactcctctaaactctgtgctgggagactcttctgcttctgagccaggcttgcaggcagcctctcagccggccgagactccatcccaacagggcattgtcttgggaccacttgcacctccacctcctccaccactcccaccagggcctgcacaggcttcagtagccctccctcctcccccagggccccctccacctcctccactcccatccaccgggcctccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaat

SEQ ID NO: 129643 - DNA, 1978 bp, Homo sapiens
  Payload ID: 5354
  Gene Symbol: EVL
  Gene Name: Enah/Vasp-like
  Uniprot ID: Q9UI08
  ENST ID: ENST00000392920
  CDS Start-End: 224-1480
gtgttagcttcttgtttctctattttctacctaggtttcagtttttcacttgggtttgtttcccctttgtctctggttcagcttccttttcctgtttggttttaagtaggctataaaaatcaagttgctgtcttcagagggtctgtggtcctctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 129644 - DNA, 2353 bp, Homo sapiens
  Payload ID: 5354
  Gene Symbol: EVL
  Gene Name: Enah/Vasp-like
  Uniprot ID: Q9UI08
  ENST ID: ENST00000402714
  CDS Start-End: 605-1855
ggtggggccccgcgccttttgtgtcgggctttgaccgccgcgcgcgctcattcacctcagcggccgcgggcggaggggcgcacgcgcgcgcagtcccctcggagggcggtggggcgaacagcaacgcgcgtaccctagctcttggctgctgtgctgagactagcccgcgcgcccgcgcgcctctccctcgaggactcggagccgcccgcgcactcgccaggggccgccgccccgagtctcaggcggacgcgcacgcgttcccgccgcccggaccccagccggctcgccccccgcccccccatcccccggcggcggcccccaggcacgcgcccgcgcacacgccggcccgggcacgcgcccgccaagatggcaggggccggggcccagctgtcagtcgccgccgccgcggcccttccccgcagctagcggccccgacgcccacccggagaagatgagcccccgctgccccccgcagcccagtcagacgcggagccgccgcgcccggggccggctcccccgctagcgcccgcgtcccgcgccccgccgccgccgccgccgccgccgggtcgcccctggcccggcgcgcccgtccccggcagcgacaatgagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgca

SEQ ID NO: 129645 - DNA, 3704 bp, Homo sapiens
  Payload ID: 5354
  Gene Symbol: EVL
  Gene Name: Enah/Vasp-like
  Uniprot ID: Q9UI08
  ENST ID: ENST00000544450
  CDS Start-End: 284-1456
agttcccagcctggagcctaagcatacactgcattaatcagacttgctggaatgatcacatggttttctagctgcctcccctgttagctgccgcttgtcagcagctggcggagctggaggctgcaggcccctgtctgcagaaagccttttacttcagaatattggggggtgtggaaaccccgcctcatttttctgcactttgcaccatctgactaactaaatggttgtcctccataccaaaaagactaccacacaatctaaggaaattgtctctgactaggtcatgtttgcatttgaagaattcagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagg

SEQ ID NO: 129646 - DNA, 583 bp, Homo sapiens
  Payload ID: 5354
  Gene Symbol: EVL
  Gene Name: Enah/Vasp-like
  ENST ID: ENST00000555706
  CDS Start-End: 239-583
tgtggtcctctgatcaacataggctggtgggagtacaggactcgcctcctcagggttccctgtgctgccacttttcagccatggccacaagagctgtaaacttacctccctgaagtcttgttgctggcaaacaatagagccagacctggggcagagctggagctgttgtccacagtgttctcacttccccgcgctgactccatgtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggc

SEQ ID NO: 129647 - DNA, 883 bp, Homo sapiens
  Payload ID: 5354
  Gene Symbol: EVL
  Gene Name: Enah/Vasp-like
  ENST ID: ENST00000557384
  CDS Start-End: 238-883
tattaatgcattcaaagtactagacactatgcagagggctataggaggcataaatatgaattatagaagacttgcccttaggagctttatatctagaaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcag

SEQ ID NO: 129648 - DNA, 1754 bp, Homo sapiens
  Payload ID: 5354
  Gene Symbol: EVL
  Gene Name: Enah/Vasp-like
  ENST ID: ENST00000554045
  CDS Start-End: 70-435
gatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactg

SEQ ID NO: 129649 - DNA, 819 bp, Homo sapiens
  Payload ID: 5354
  Gene Symbol: EVL
  Gene Name: Enah/Vasp-like
  ENST ID: ENST00000554031
  CDS Start-End: 1-314
ctggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatgtgaacatgcactaagtttatcattaacagagaagaaagaaggcttatttgaaagacgaaaagagccccaaatgtggagtccggtgacttgggcaggccctctgccatggcagagctggccctgggccaatggagttactgctccgaggaccagttccaccacctgaaaacctgcacccaggcatggccgcctcacagactgtgcgactgccagaggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctcca

SEQ ID NO: 129650 - DNA, 1119 bp, Homo sapiens
  Payload ID: 5354
  Gene Symbol: EVL
  Gene Name: Enah/Vasp-like
  ENST ID: ENST00000554695
  CDS Start-End: 1-639
ccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaata

SEQ ID NO: 129651 - DNA, 837 bp, Homo sapiens
  Payload ID: 5354
  Gene Symbol: EVL
  Gene Name: Enah/Vasp-like
  ENST ID: ENST00000553875
  CDS Start-End: 72-446
ctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggtgcgtgcatcctctaatgacaaagcaaccttgtatttccttccacaaatgaatggaggcagcctaacgtcatgtggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagct

SEQ ID NO: 129652 - DNA, 590 bp, Homo sapiens
  Payload ID: 5354
  Gene Symbol: EVL
  Gene Name: Enah/Vasp-like
  ENST ID: ENST00000557153
  CDS Start-End: 86-590
ctcatccggtggttttcgcagcacgctacacaggcacagaagcagcttgcatgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggc

SEQ ID NO: 129653 - DNA, 1715 bp, Homo sapiens
  Payload ID: 5354
  Gene Symbol: EVL
  Gene Name: Enah/Vasp-like
  ENST ID: ENST00000555048
  CDS Start-End: 77-928
gtcctctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggagccaggaaaactgagccccagagggaggaagtttgtacttggcccaaaccacttcctgatatgacccagtcaggaagagaagccaggatgagaacatgctcctcttctcctccagtgcctggaagtgtggtgggagcagcttggtctagcaggaagagtgcatgtcctggagccgggctacgttgggtctgtgtgaccctgagcaagtcacctcctccatcagcaggtggaatgacaccacaggcccgtggcagttcacatgacacgaagatgcccggtgcctggtatgtggccttcagggccgtgccccatgctgctcctctttttgtccccacatccagcagttttccattaaaccactgtaggtcctctcagaacttactagagtcatcgtgtcatcgtctcccattactccaggagagcagggccctggtggcacttgaggcaagaccccaagctgatggcactcgaccacatagtgggagtgaattttaaagaaaatccccctcaaagcctctgctggtgtagaaggcagatagtctaggccggggtagggccagtgagtgggagccagggaaggaggcttgggtgtcatgagactgggtttacatttacagatgacaaaaccaagacccagtgagggggaggatgtgtgcaggccacaggacaagtctgagcagaaccatggccacgcccaacgttcctccactagcattccctcatgaaagatcactttttccaggccaaggaccagaaaaggaccaggctttaggaagagggccgaggtgcatggaaagcagtgctggtgaggagagggttgagtaactggattttgactgtttcttcgcatttggttctcactaatgaaatcttgtcagacgtgcccctgctgctggattgggtgggggtgggacagaagcatgtgtggtcaaaggcaagtttatttgcagtttgggggttgaatgcagtggatttcaaactggatattttgaggagttccaggggtccaccaaggtataccagggtcctcgccctgatgcaaccagagtagttcttcatcgactttatacagtgggactctgaagaaaagaaaaaggaaaaccccatagcttagtgggaatccgggcgaattaaaacacaggatgaagtgcttgttctctttggctcttggagcataatgtatgtccttttcctacttggtttgcgtgtaataacatcattggtatatttcaaaatatgaagctcctggtgctggataataaatgttttcccagtttttcaa

SEQ ID NO: 129654 - DNA, 5679 bp, Homo sapiens
  Payload ID: 5355
  Gene Symbol: ENAM
  Gene Name: enamelin
  Uniprot ID: Q9NRM1
  ENST ID: ENST00000396073
  CDS Start-End: 282-3710
ctttttattttgagcctttttgatactgaacatgatatctgagtgaagaatttttgttttattattaagaaataaatgtatcttgcttcttgagatctccctggcttcagcaatttgtagttatttccactatagaccattaagaatatatttcaaaggcaagctaacaaagttcaagtaaaaattattttttatatattacagcttctaattggcattggtttcttctcaggttaaagctgtatttttcttaaaggcttataaaaattttgctgaaaaaaatgttggtgcttcggtgcaggcttggaacctcttttcctaaactagataacttggtaccaaaaggcaaaatgaagattctcctggtctttctagggcttcttggtaattctgttgctatgccaatgcacatgccccgaatgcctggatttagcagtaaaagtgaggagatgatgcggtataatcaattcaactttatgaacggcccacatatggcacacctggggcccttctttggaaacggtctccctcagcaatttccacagtaccagatgcccatgtggcctcagccaccacccaacacatggcatccacggaaatcctcagcacccaaacgtcataacaagactgatcagacccaagaaacccagaaacccaaccagactcagtcaaaaaagccaccacaaaagcggcctttgaagcagccatcacataatcaacctcagcccgaagaggaagctcaaccccctcaggcattcccaccatttggaaatgggctattcccctatcaacaaccaccatggcaaattccacagaggttaccaccaccaggttatggacgcccaccaatcagcaatgaagaaggggggaatccttactttggatattttggatatcatggctttgggggtcgccctccttattattcagaagaaatgtttgaacaagattttgaaaaacccaaagaagaagatcctcctaaagcagaaagtccaggcacagaacccacagctaattcaacagtcactgagacgaattctacccaaccaaatcctaaagggagtcagggaggaaatgacaccagccccacaggaaacagtaccccaggactaaacactgggaacaaccctccagctcaaaatgggattggcccactccctgcagtcaacgcttcaggccagggagggccaggaagtcaaatcccatggagaccaagtcagccaaatattcgtgaaaatcatccatatcctaatataagaaattttccttcaggaagacagtggtatttcactggtactgtcatggggcacagacagaataggcctttttacagaaatcaacaagttcaaaggggtcctcggtggaacttctttgcttgggaacgtaaacaagtagctcgtccaggaaatccagtttatcacaaagcttaccctcctacttcaagaggcaattatcccaattatgcaggaaatccagcaaatctcagaagaaagcctcaggggccaaataaacaccctgtaggaactactgttgccccactgggtcccaaacctggccctgttgttcgcaatgaaaaaatccaaaatccaaaggagaagcccctgggtccaaaagaacaaataatagttcctacaaagaatccaaccagcccctggagaaactctcaacagtatgaagttaataaatcaaattataaactgcctcactctgagggttatatgccagtcccaaattttaattctgttgatcaacatgaaaactcctattacccaagaggagattccagaaaagtcccaaattctgatggacaaacccaaagccagaatttgcccaaagggattgttttagggtcaagaaggatgccatatgaatcagaaactaatcagtcagaattaaagcacagctcatatcagcctgctgtataccctgaggaaatcccttctcctgcaaaagaacattttcctgctggaagaaatacttgggaccaccaagaaatctctccaccttttaaggaagatccagggaggcaagaagaacatttaccccatccttcccatggttctagaggaagtgttttctaccctgaatataacccatatgatcccagggaaaactcaccataccttagaggcaatacatgggatgagagagatgattctcccaatactatggggcaaaaagaaagtccactctaccccataaataccccagaccagaaggagatagtcccttataatgaagaggacccagttgatccaactggagatgaagtctttcctggacaaaatagatggggtgaagagttgagcttcaaaggaggcccaacagttaggcactatgaaggtgaacaatatacctcaaatcagccaaaggaatatcttccctattctttagataatccatcaaaaccaagggaggatttttattacagtgaattttacccatggagcccggatgagaattttccatcatataatacagcttctactatgccaccacctatagagagcaggggctactacgttaataatgccgctggaccagaagaaagcactctatttccttcacggaattcctgggaccacaggatacaagcccaagggcagagagaaagaaggccgtattttaacagaaatatctgggatcaggcaacacatttacaaaaagccccagctaggccaccagaccagaaaggtaaccagccctattacagtaacaccccagctgggcttcagaaaaatccaatatggcatgaaggtgagaatttgaactatggcatgcaaataactaggatgaattctccagagagagaacattcatctttccctaacttcatcccaccaagttacccatcaggtcaaaaagaagcacatttatttcacctaagccagagaggctcttgctgtgctggtagctccacagggcccaaggacaatccactagctctacaagactacactccatcctatggtcttgcacctggggagaaccaagacaccagtcctctgtatacagacggtagtcataccaagcagacaagagatatcatctccccaacaagcatcctaccaggccaaagaaacagctcagagaagagggaaagccaaaacccttttagagatgatgtgtccacgctgaggaggaacacaccatgttctataaagaatcaactgggccaaaaggaaattatgccctttcctgaagccagttcccttcaatcaaagaatacaccttgtctcaaaaatgatcttggaggagatgggaacaacattctggaacaagtttttgaagacaaccagctcaatgaaagaactgttgaccttactcctgagcagcttgttattggtacacctgatgaaggctccaatccagaaggcatccaaagtcaagtccaagaaaatgagagtgagaggcaacagcaaagaccatctaacattctgcatttgccatgctttggctccaaattagcaaagcatcactcttccaccaccggaactccatctagcgatggaaggcaaagcccatttgatggggattcaattacgcctactgaaaatcctaacacattggttgagttagctactgaggaacaatttaagagtataaatgtagacccacttgatgcagatgaacacagtccatttgaattccttcaaagagggaccaatgtacaggaccaggtacaagactgcttactacttcaggcctaggggttatccaaccaagcattcttggggaaagagaaatcactgacattctataccaatggttcccaaaattttttccccaagacttaattaagtgtctgactgtcttggtgatccttaagttttctcccctctcagcaataggagtagcgacccaggtggagctgagattaggcctctggggatcaccagatctagcactttcacagattagtgcagaccttaaaaaagcaagaaggccatgaccatccctgcctcgaaacttgcaagtcacttgtctgagttagtttccttttgcttgatgacttcttttgctctcaaagttccatacttgcaaaattggtttttcaagactgaaaggcagattaactttccattctacttatggagatccacacatcagtatagtcctgatgcactgtacgttttttgcttgtgttgatcttgtcaggtttttttcctactcaatattctcttcaagcattttttttcttccactgccactctctttacctttatcatttctttttcttagctttcttccttcttttctctctccctcaaccattctgtatttagctttctaatcctcatctttttctctctgtatatcacttcttacatattaaattagctattttaaccatttctagtctcttctttatgtctacctcctccattatgtcttcgtctcttccaacctatctgttctgtctcccaatgtaccacttatcaactaatccctctcctctctgattcctttcttcccttcaatttatctttttccctgttacaccattttcatcttaagactgcatgtcactctcttcctttttgtatccactctccaaatcgtaccctaaatttttcttgacccagcttaaccatcattacagaatatattttggaaatggtagacactgatagctactttgtttttagttatcttagggtctctaccaagtagacacagttcagttagagagacgtatttaaggagaagggaaggcaggatacccagaactagcagcctagggaaaaggcttaggaagatggagaatgaggaactgaagaaactgccgctctgagactgcacatccaggaaaaaagactaggacttgccacacactgccaattcataatccgcaggatctgtagaagacattttgggaaacactgtcttaaataaaaactcaatgtttagttgtttttttttttttttactagttcagcataagggattctaccagtatgtgctactactaacattcttcatgtccatgcagaattacttacagacactctttcttggtatcttgaataaattgtgtaaattattttgaaaagtggatatttctatatgccttgcttataatacatcagggattattattcttattaataacatgttggcctattatctggatgtcccttgcctagagcaggaaaaaagtctcagaattacctaaaaacatactttataactttaagagatttcttaggatacatcttcaggggcagatttcataacaacatctcaaaaatttggggaaacacaacgttgaaaacttcctaagaaaaggaatcttgcccttgaatcttctgaagtacctagcacagtgtcttcaacatagaaggtacccaataaatatatatcaattcattttttaatgactttcaacactcccatgaaaacaccgtagtctgcttttcctgaaaggtgactgtctaggatgctgaatgagccaccactccgtagctttatatattcagcaacatttccatcatagaatttcagcgttagaagggatcttagaggtagattatccaggccatcccctactgcttacattcccctccccctggccagttttatattttaatcacacattgaaaaattcattaacttattctgtataaaactgtcttttaagaattatcctttcaaaataaaaatgttattgtttcacta

SEQ ID NO: 129655 - DNA, 2792 bp, Homo sapiens
  Payload ID: 5356
  Gene Symbol: EXOG
  Gene Name: endo/exonuclease (5'-3'), endonuclease G-like
  Uniprot ID: Q9Y2C4
  ENST ID: ENST00000287675
  CDS Start-End: 97-1203
agcttggcgggcggtgaggcgtggggtgacggggggatggcgggggccggcatgcgcgcgcatgcgccgtggtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctctttaggctaacatattttagtggctttgctttttgctttttaaaaagtttttctctttaagagatgtggtctcgccgtgtcatccaggctggagtgcagtggtggaatcatagctcactatagcctcaaacttctgggcttaagcaatcctcctgcctctgccccctgagcagctgggactacaggcacacaccatcaccctcagctactagtggctttgctttaaagaaacagtggaatcctaaatttatgactaaaaattcccccaaaagatgaaagatctacaatgtttttgtcagtattatatttgactcaggaactaattattaagggagctttgacacctgcagatggagggctgatcttgtgtcaagttaacaggaagactgcccacagatgacactgcatttgtatccctgtggatgtagagtattgggaaggcatttgtttagtttcatgcctccaaaccatgcattgtctgtgatgtatctgcccagccttctcagaactcaatgttgtacatttttccctctaggacctgaattggtcttggaggcagcttttagaaatcctctgtgtagttcctgtccacatgcactatatatttgtttcttttttctcctctcatgaatctgctcgtttctctacttctgtctacgtagaagcactcagcaactagtttctgctcattaaatgtgttctatatactaggctcagtgctttacatgtgttgtctcacaatgactctctgaggtaaatacactatccccattttacctgtgagaaaattgaggcttagagagcttagtgtcttacctgagtttcacttttccaaagtagtcatccacaaagtatgaggcagacagatctaagagaagaaagacagctgaggtagattcaaatcttttctgacatggatggtggctttttactcagaaatatatacctatttccatgggtatttgtgggcctgaggcatgcttggcaagaagagtctggtttctcgtctgctatgcaagccaaagggactttaatgttctttgaattgaaccctccttagctctgtggaaagagacagtcaggaatatttgggaattagacggcaatactttgtggggtttattagagcccatgcttgcctccagagatacagttcttttagtgaccagatactgccaaattgatgtgttcttgctttccaggtgagctttttgttcttaagattaagaaacctatgaaggatctgcagccaggcatggtggctcaggcctataatctcagcactttgggaaatcgaggtgggtggatcgcttgagcccaggagtttgagaccagcctgggcaacataatgaaaccctatctttacaaaaaaatacaaaaattagctgggcgtggtggtgcacacctgtagtcccagctactcgggaggctgaaatgggaggattgcttgagcctggcaggtcaaggctgcgatgggacatggtcatgccactggacgccagcctgggccacagagggagaccctgtctcaaaaaaag

SEQ ID NO: 129656 - DNA, 1255 bp, Homo sapiens
  Payload ID: 5356
  Gene Symbol: EXOG
  Gene Name: endo/exonuclease (5'-3'), endonuclease G-like
  ENST ID: ENST00000431472
  CDS Start-End: 27-350
ggtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggctggtcttgaatttctgggttcaagtgaccctcctgcctcagcctcctgagtagctgggattacaggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctcttta

SEQ ID NO: 129657 - DNA, 576 bp, Homo sapiens
  Payload ID: 5356
  Gene Symbol: EXOG
  Gene Name: endo/exonuclease (5'-3'), endonuclease G-like
  ENST ID: ENST00000453767
  CDS Start-End: 1-562
cttccggagtcagggcgctgagggagcgttgacagggaagcagccggatggatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccagagctgggagtacccaagcctgcagttttgacctttgaatgtttg

SEQ ID NO: 129658 - DNA, 1467 bp, Homo sapiens
  Payload ID: 5356
  Gene Symbol: EXOG
  Gene Name: endo/exonuclease (5'-3'), endonuclease G-like
  ENST ID: ENST00000412107
  CDS Start-End: 242-412
attttcttctcatgactatatatagcataccactaagccctctagacatcatattccccatccatcgccccgtccagtggaccagggatgaagcggggatgcgctaggcatcccggtttgtcaccagggggcgtgcgaggccctcagcttggcgggcggtgaggcgtggggtgacggggggatggcgggggccggcatgcgcgcgcatgcgccgtggtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatgattgttagctccataagacttgagactatgtctgttttggtctccatcatctaaccagcacagtacctggtacataattggcattcagatctgcagaaaaggctgtcttggaacaatttggattccctttaactggaacagaggcaagggaactaaaagagtgccagtagatgaatgagggggaaggtgatgtgaaatgatgctggagaagtaagcaggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctc

SEQ ID NO: 129659 - DNA, 2075 bp, Homo sapiens
  Payload ID: 5356
  Gene Symbol: EXOG
  Gene Name: endo/exonuclease (5'-3'), endonuclease G-like
  ENST ID: ENST00000457367
  CDS Start-End: 4-435
aagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtagattcttcaagtttacactcctagcatcattgtttcttctctctctcaaccttcacctatggctggtcttgaatttctgggttcaagtgaccctcctgcctcagcctcctgagtagctgggattacagggactacatggaaggttgtcttggcactgaacggagaaaggtcaaaaggaagataaaaagtttgttccagagaaggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctctttaggctaacatattttagtggctttgctttttgctttttaaaaagtttttctctttaagagatgtggtctcgccgtgtcatccaggctggagtgcagtggtggaatcatagctcactatagcctcaaacttctgggcttaagcaatcctcctgcctctgccccctgagcagctgggactacaggcacacaccatcaccctcagctactagtggctttgctttaaagaaacagtggaatcctaaatttatgactaaaaattcccccaaaagatgaaagatctacaatgtttttgtcagtattatatttgactcaggaactaattattaagggagctttgacacctgcagatggagggctgatcttgtgtcaagttaacaggaagactgcccacagatgacactgcatttgtatccctgtggatgtagagtattgggaaggcatttgtttagtttcatgcctccaaaccatgcattgtctgtgatgtatctgcccagccttctcagaactcaatgttgtacatttttccctctaggacctgaattggtcttggaggcagcttttagaaatcctctgtgtagttcctgtccacatgcactatatatttgtttcttttttctcctctcatgaatctgctcgtttctctacttctgtctacgtagaagcactcagcaactagtttctgctcattaaatgtgttctatatac

SEQ ID NO: 129660 - DNA, 1317 bp, Homo sapiens
  Payload ID: 5356
  Gene Symbol: EXOG
  Gene Name: endo/exonuclease (5'-3'), endonuclease G-like
  Uniprot ID: Q9Y2C4
  ENST ID: ENST00000422077
  CDS Start-End: 24-980
aaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctctttaggctaacatattttagtggctttgctttttgctttttaaaaagtttttctctttaagagatgtggtctcgccgtgtcatccaggctggagtgcagtggtggaatcatagctcactatagcctcaaacttctgggcttaagcaatcctcctgcctctgccccctgagcagctgggactacaggcacacaccatcaccctcagctactagtggctttgctttaaagaaacagtggaatcctaaatttatgactaaaaattcccccaaaagatgaaagatctaca

SEQ ID NO: 129661 - DNA, 1750 bp, Homo sapiens
  Payload ID: 5356
  Gene Symbol: EXOG
  Gene Name: endo/exonuclease (5'-3'), endonuclease G-like
  ENST ID: ENST00000447573
  CDS Start-End: 26-196
gtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatgattgttagctccataagacttgagactatgtctgttttggtctccatcatctaaccagcacagtacctggtacataattggcattcagatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatggggactacatggaaggttgtcttggcactgaacggagaaaggtcaaaaggaagataaaaagtttgttccagagaaggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctctttaggctaacatattttagtggctttgctttttgctttttaaaaagtttttctctttaagagatgtggtctcgccgtgtcatccaggctggagtgcagtggtggaatcatagctcactatagcctcaaacttctgggcttaagcaatcctcctgcctctgccccctgagcagctgggactacaggcacacaccatcaccctcagctactagtggctttgctttaaagaaacagtggaatcctaaatttatgactaaaaattcccccaaaagatgaaagatctacaatgtttttgtcagtattatatttgactcaggaactaattattaagggagctttgacacctgcagatggagggctgatcttgtgtcaagttaacaggaagactgcccacagatgacactg

SEQ ID NO: 129662 - DNA, 1440 bp, Homo sapiens
  Payload ID: 5356
  Gene Symbol: EXOG
  Gene Name: endo/exonuclease (5'-3'), endonuclease G-like
  ENST ID: ENST00000438992
  CDS Start-End: 4-174
aagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatgattgttagctccataagacttgagactatgtctgttttggtctccatcatctaaccagcacagtacctggtacataattggcattcagatctgcagaaaaggctgtcttggaacaatttggattccctttaactggaacagaggtagattcttcaagtttacactcctagcatcattgtttcttctctctctcaaccttcacctatggctggtcttgaatttctgggttcaagtgaccctcctgcctcagcctcctgagtagctgggattacaggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctctttaggctaacatattttagtggctttgctttttgctttttaaaaagtttttctctttaagagatgtggtctcgccgtgtcatccaggctggagtgcagtggtggaatcatagctcactatagcctcaaacttctgggcttaagcaatcctcctg

SEQ ID NO: 129663 - DNA, 1548 bp, Homo sapiens
  Payload ID: 5356
  Gene Symbol: EXOG
  Gene Name: endo/exonuclease (5'-3'), endonuclease G-like
  ENST ID: ENST00000454803
  CDS Start-End: 24-464
aaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggatctgcagaaaaggctgtcttggaacaatttggattccctttaactggaacagaggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccagagacttaactaagcttttactaggtacctggtgctgttctgggtgcttctgatacagcattaaacaaggcagaaaagagtaccctcatggagcatgcattatagtggaggagatacctagtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcacacaccatcaccctcagctactagtggctttgctttaaagaaacagtggaatcctaaatttatgactaaaaattcccccaaaagatgaaagatctacaatgtttttgtcagtattatatttgactcaggaactaattattaagggagctttgacacctgcagatggagggctgatcttgtgtcaagttaacaggaagactgcccacagatgacactgcatttgtatccctgtggatgtagagtattgggaaggcatttgtttagtttcatgcctccaaaccatgcattgtctgtgatgtatctgcccagccttctcagaactcaatgttgtacatttttccctctagga

SEQ ID NO: 129664 - DNA, 576 bp, Homo sapiens
  Payload ID: 5356
  Gene Symbol: EXOG
  Gene Name: endo/exonuclease (5'-3'), endonuclease G-like
  ENST ID: ENST00000443942
  CDS Start-End: 29-199
gtggtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatgattgttagctccataagacttgagactatgtctgttttggtctccatcatctaaccagcacagtacctggtacataattggcattcagatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtgtaggcat

SEQ ID NO: 129665 - DNA, 1679 bp, Homo sapiens
  Payload ID: 5356
  Gene Symbol: EXOG
  Gene Name: endo/exonuclease (5'-3'), endonuclease G-like
  ENST ID: ENST00000436414
  CDS Start-End: 97-342
agcttggcgggcggtgaggcgtggggtgacggggggatggcgggggccggcatgcgcgcgcatgcgccgtggtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggatctgcagaaaaggctgtcttggaacaatttggattccctttaactggaacagaggtagattcttcaagtttacactcctagcatcattgtttcttctctctctcaaccttcacctatggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctctttaggctaacatattttagtggctttgctttttgctttttaaaaagtttttctctttaagagatgtggtctcgccgtgtcatccaggctggagtgcagtggtggaatcatagctcactatagcctcaaacttctgggcttaagcaatcctcctgcctctgccccctgagcagctgggactacaggcacacaccatcaccctcagctactagtggctttgctttaaagaaacagtggaatcctaaatttatgactaaaaattcccccaaaagatgaaagatctacaatgtttttgtcagtattatatttgactcaggaactaattattaagggagctttgacacctgcagatggagggctgatcttgtgtcaagttaacaggaagactgcccacagatgacactgcatttgtatccctgtggatgtagagtattgggaaggcatttgtttagttt

SEQ ID NO: 129666 - DNA, 710 bp, Homo sapiens
  Payload ID: 5356
  Gene Symbol: EXOG
  Gene Name: endo/exonuclease (5'-3'), endonuclease G-like
  ENST ID: ENST00000450732
  CDS Start-End: 1-324
cggagtcagggcgctgagggagcgttgacagggaagcagccggatggatctgcagaaaaggctgtcttggaacaatttggattccctttaactggaacagaggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccagctgaggtcatccctgtgctttctctgatgttcctgtttcaagaagaggttgattccagacaagtgaaacatacctgaagattctggtttggacattataaatggtctgacaagaaagtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcc

SEQ ID NO: 129667 - DNA, 455 bp, Homo sapiens
  Payload ID: 5356
  Gene Symbol: EXOG
  Gene Name: endo/exonuclease (5'-3'), endonuclease G-like
  ENST ID: ENST00000470291
  CDS Start-End: 1-47
agggcgctgagggagcgttgacagggaagcagccggatgattgttagctccataagacttgagactatgtctgttttggtctccatcatctaaccagcacagtacctggtacataattggcattcagatctgcagaaaaggctgtcttggaacaatttggattccctttaactggaacagaggcaagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtacctggtgctgttctgggtgcttctgatacagcattaaacaaggcagaaaagagtaccctcatggagcatgcattat

SEQ ID NO: 129668 - DNA, 197 bp, Homo sapiens
  Payload ID: 5356
  Gene Symbol: EXOG
  Gene Name: endo/exonuclease (5'-3'), endonuclease G-like
  ENST ID: ENST00000630638
  CDS Start-End: 27-197
ggtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatgattgttag

SEQ ID NO: 129669 - DNA, 4626 bp, Homo sapiens
  Payload ID: 5357
  Gene Symbol: ENGASE
  Gene Name: endo-beta-N-acetylglucosaminidase
  ENST ID: ENST00000300682
  CDS Start-End: 1-551
ctcagttttttcgttttgatggctggctgatcaacatcgagaactcgctgagtctggccgctgtggggaacatgcctcctttcctgcggtacctcaccacacagctgcaccggcaggtcccagggggcctggtgctctggtatgacagcgtggtgcaaagtgggcagctcaaatggcaagacgaactcaaccagcacaacagggtcttctttgattcctgcgacggcttcttcactaactataactggcgggaggagcacttggagcggatgctggggcaggctggggagcgccgggctgatgtgtacgtgggcgtggatgtgtttgctcgagggaacgtggtcggaggccgattcgacacagacaaggtgggtggtggctttcgtccaagggccagcggcccagtgcctcccctgggacctcatttcctcatggaccttccattcccgtctgcacctcaaaggaatgacagcagctgttcttcccagagtggggatcccgtggcactgagaaacaggtgtcctgccccggccaagctatgtccccactgaaacccctttcccggctatttctacaatcagataatgtatttttgtgtgggtgttaccagacagaggcgcgtcgttcccccgctgtccggtcctcggcgggcctgggcctcctgtcccagctgcgttccttgatcttccccgtgagggaagcctgcggggacgcacaggggcctgcagcgcctctcactgcggctcaggggcgaggacgggggaggtgcccagggtttggggatcggtaggtgtcatgacgagggagcattttctggcaaggcaggtcacaccagcacagaggaaggagcggggccaggccggtgcccctggcgtgggatgcgcagggctctgcctgcctctggtctatcagtcctgcccgttcccagagccccagggatgttctcagcccttaatttagctttaaatgagtaaattaatccaataactaaagagcctctttactgcccgtgattctgataatcgaatgagaggtgtgccagaggacaatgggaccgcgcagccacagccagttggggcccagcccctgcccccctgcccttgcagcagcgctgaccgcctctcccgcgccctcttctggcgggcttgtggaacgacgggggtgatgcccagcagcctccagtcgttggagctgatccgaaagcatggcttctccgtggctttgtttgcccccggctgggtgtatgagtgtctggagaagaaggatttcttccagaaccaggacaagttctggggccgactggagcgttatctgcccacacatagcatctgctccttgcctttcgtcacgtccttctgcctgggcatgggtgcacggagggtctgctatggccaggaagaggcggtagggccctggtaccacctgagcgcccaggagatccagcccttgtttggagaacacaggctgggaggggatggccggggctgggtgaggacgcactgctgcctggaggatgcctggcacggaggcagctccctgctcgtccggggtgtgatcccaccggaggttggaaatgtggctgtgaggttattttccctgcaggccccagtgccacccaagatttacctgtccatggtgtataagcttgaggggcccacggacgtcacagttgctttggagctgaccacaggggatgccggcagctgccacatcggtggcatctcagtgttgaacgcagaaacaagctcaagacacagcctccgacccctccgggtgccccccaccaagctggccagatgggtgggccgctgcggccggcagctgagtgggggctgggtccagcactgctacgaggtgagcctgcgtgggtgcctgctgctagacctcctcgtttgcttctcacggccgccgggtagtcgggaggaggagagcttcacctgtcggcttggagagatccaggtggtggacgctgccagcctgctggcccctctgccccaggtgcaggccgtcaccatctctcacatccgctggcagccatccgcctctgagcgggaggggccccctgctctgctccagctcagctgcaccctgcactggtccttcctcctctcacaagtccgttgcttccgaatccactgctggggagggatgagtgatgactctccgggcagggagctgccgaggccagagatgcccatgttcctggggttggcttttgccacccagtaccggatagtggacctgctggtggaagccgccgggcccggccaggatcgtcgcatggaatttctggtggagcctgtccccaaggaagggttccgggtacctcaggccgagtggggcagggcagttctgctttattcagcccctgcatgagcggatgctaaggccgggtggtctcctggcctcgggctgaggcctcttcccggctgtctgcccctggcctgcgctggacctgctaagtgcccacagtggcagcgaggtcccggtcccggggctggggtgggagaccccgggctgagtgctgtggctttctggtggggggcgatggaaacaggaaaccaagcagtgggatcgcagcgttggtcactgcgaggcgagtggcgggctttctgtttctgccttgtccctccccacggtacctggttcccaggtgaaaatgaaaggaggggagaagttgagaacagaacattccataaaggatatttcctaataggctgcaagatgctgatgccgagaatgatgattttctttcctgcagatgaaactattagaaagggtcttagattgtggcaggtaggctttggagcaggcgccgagacatttctgagcatgaggacgagctacagcagctcctggggtggggctgcctgcgggatggcgggagaggatgccctggagaaccgtcctcccagtgtggaaggcccttttccctgaggagtgggcattctgggccagccggcgctggcttcgtgcctccacgtgggccagccccagctgctccgtgtttcctggcgttggcaatttactgtgctgctgagtgtgaggtcatctccggagcgttttcagcagcccctggctctgcggcgtctcttccgggctgtgggcatgcagggaagtggctctgaggcagtctgcgctgtggccctgcctctgcccagcgagaggccgtgggctctggacaagccgcccttcaggctggggtagcaggtcagtccaggcaggaagcagcacctgccccccgcgccagcccagccccagcctgagtgcaggagctgcaggacccgcgggggcttttccagctactctgttccttcacgtcctcccttctcagcctcgtccaagcaccgggaagacctccaggctgaccccttgagcagcagtcagcacaggtgcgtgggggcgtgagggaggcagggtcttcaccacaggcgccttcctctgtccttcctgctctttcttctctgcccaggccgctgcagctgcacagcctctgctacacctgggctgcctgggaggcttcctggtgtggtgtctggaccccacggccttgggtcatcctgtggctggtctggggtggggtctgttgtggtccttccacggtgtcagtggcctgaagtccctcgcttttggggggggggtctctcacccccaggccacatagggccagtggtaggggttccctctatgtcgggcagtgctgagggctgggatgctctgtgaccccagctggagcccacacctaagggctggcatccacatcatttcaccctgcagtgagggaagaggccaccaggtggcagcacagccacacccgttcccacgtcagaggagggcaaggctgggtactcagcagccactctgagccggggctccttccaggagctgaaatccacctgtctccatcttccttgcctgcctgggtactcatgccaagcagagactgggattaggggttctgtgctcttgcctaattaggaacattctcccatgtctcttgtgtggtcccagaaggagaagtgagtttgccaaggatatggggcaggaggctccctctgctgaccccctgcagcctggagccagcccggggactgtcctgggtggagggcaggtgaacacaagctgctgccggggactgtcctgggtggacggcaggtgaacacaagcggctgccgcatgtagccactcactcgactttttttcagctgtgaccattcccgggagctctttgagcctttctgtctcatttggaaccagggggaaccaggaaggggctcctggcctctctgtgtcctctgcagtgggggttgtggggggcgcagcatccacgccttgctgcccttctttcatgaagtctgttttttaagtgctggttcccccgaatattttatgcagaggagggaaaatttatagtggcaattattttctcacagtctggtgagcaggcaattaattaggagtaagggggcctagtagagcgtggcgtgtggcagaatcgcaccgccccggctccccagcccaccgccatgcagggctcgcgtgcgggaaaactaatatgccggcgtttaagcctgtgcccctctgctgggtgtaactgcgctgaaataaatgatctgacaatgtgaa

SEQ ID NO: 129670 - DNA, 1381 bp, Homo sapiens
  Payload ID: 5357
  Gene Symbol: ENGASE
  Gene Name: endo-beta-N-acetylglucosaminidase
  ENST ID: ENST00000311595
  CDS Start-End: 1-1097
ggcggcggcggccgggaaggagcatcaaagatgaagaagaagagacagtctttcgagaggtggtcagtttttccccggaccccctgccagttagatattatgacaaggacaccaccaaaccaatcagcttttacttgtcttcgctggaggagctcttggcgtggaagccccgcttggaggatggctttaatgtggccctggagcccctggcgtgtcgccagccccctctgagcagccagaggccccggactttgttgtgtcatgacatgatgggcgggtacctggatgacaggttcattcagggctcggtggtgcagactccctatgctttctaccactggcagtgcatcgacgtctttgtgtacttcagccaccacaccgtcaccattcccccagtgggctggaccaacactgcccacaggcatggggtctgcgtgctggggactttcatcacggagtggaatgaagggggaaggctctgtgaagccttcctggccggggatgagcgctcgtaccaggcagtggctgaccggctggtccagatcactcagttttttcgttttgatggctggctgatcaacatcgagaactcgctgagtctggccgctgtggggaacatgcctcctttcctgcggtacctcaccacacagctgcaccggcaggtcccagggggcctggtgctctggtatgacagcgtggtgcaaagtgggcagctcaaatggcaagacgaactcaaccagcacaacagggtcttctttgattcctgcgacggcttcttcactaactataactggcgggaggagcacttggagcggatgctggggcaggctggggagcgccgggctgatgtgtacgtgggcgtggatgtgtttgctcgagggaacgtggtcggaggccgattcgacacagacaaggtgggtggtggctttcgtccaagggccagcggcccagtgcctcccctgggacctcatttcctcatggaccttccattcccgtctgcacctcaaaggaatgacagcagctgttcttcccagagtggggatcccgtggcactgagaaacaggtgtcctgccccggccaagctatgtccccactgaaacccctttcccggctatttctacaatcagataatgtatttttgtgtgggtgttaccagacagaggcgcgtcgttcccccgctgtccggtcctcggcgggcctgggcctcctgtcccagctgcgttccttgatcttccccgtgagggaagcctgcggggacgcacaggggcctgcagcgcctctcactgcggctcaggggcgaggacgggggaggtgcccagggtttggggatcggtaggtgtcatgacgagggagcattttctggcaaggcaggtcacaccag

SEQ ID NO: 129671 - DNA, 2579 bp, Homo sapiens
  Payload ID: 5357
  Gene Symbol: ENGASE
  Gene Name: endo-beta-N-acetylglucosaminidase
  Uniprot ID: Q8NFI3
  ENST ID: ENST00000579016
  CDS Start-End: 1-2232
atggaggccgcggcggtgacggtcacccggtcggctacacggcggcggcggcggcagctgcaggggctggcggccccggaggcggggacgcaggaggagcaggaggatcaggagccgcggccgcggcggcggcggccgggaaggagcatcaaagatgaagaagaagagacagtctttcgagaggtggtcagtttttccccggaccccctgccagttagatattatgacaaggacaccaccaaaccaatcagcttttacttgtcttcgctggaggagctcttggcgtggaagccccgcttggaggatggctttaatgtggccctggagcccctggcgtgtcgccagccccctctgagcagccagaggccccggactttgttgtgtcatgacatgatgggcgggtacctggatgacaggttcattcagggctcggtggtgcagactccctatgctttctaccactggcagtgcatcgacgtctttgtgtacttcagccaccacaccgtcaccattcccccagtgggctggaccaacactgcccacaggcatggggtctgcgtgctggggactttcatcacggagtggaatgaagggggaaggctctgtgaagccttcctggccggggatgagcgctcgtaccaggcagtggctgaccggctggtccagatcactcagttttttcgttttgatggctggctgatcaacatcgagaactcgctgagtctggccgctgtggggaacatgcctcctttcctgcggtacctcaccacacagctgcaccggcaggtcccagggggcctggtgctctggtatgacagcgtggtgcaaagtgggcagctcaaatggcaagacgaactcaaccagcacaacagggtcttctttgattcctgcgacggcttcttcactaactataactggcgggaggagcacttggagcggatgctggggcaggctggggagcgccgggctgatgtgtacgtgggcgtggatgtgtttgctcgagggaacgtggtcggaggccgattcgacacagacaagtcgttggagctgatccgaaagcatggcttctccgtggctttgtttgcccccggctgggtgtatgagtgtctggagaagaaggatttcttccagaaccaggacaagttctggggccgactggagcgttatctgcccacacatagcatctgctccttgcctttcgtcacgtccttctgcctgggcatgggtgcacggagggtctgctatggccaggaagaggcggtagggccctggtaccacctgagcgcccaggagatccagcccttgtttggagaacacaggctgggaggggatggccggggctgggtgaggacgcactgctgcctggaggatgcctggcacggaggcagctccctgctcgtccggggtgtgatcccaccggaggttggaaatgtggctgtgaggttattttccctgcaggccccagtgccacccaagatttacctgtccatggtgtataagcttgaggggcccacggacgtcacagttgctttggagctgaccacaggggatgccggcagctgccacatcggtggcatctcagtgttgaacgcagaaacaagctcaagacacagcctccgacccctccgggtgccccccaccaagctggccagatgggtgggccgctgcggccggcagctgagtgggggctgggtccagcactgctacgaggtgagcctgcgtgggtgcctgctgctagacctcctcgtttgcttctcacggccgccgggtagtcgggaggaggagagcttcacctgtcggcttggagagatccaggtggtggacgctgccagcctgctggcccctctgccccaggtgcaggccgtcaccatctctcacatccgctggcagccatccgcctctgagcgggaggggccccctgctctgctccagctcagctgcaccctgcactggtccttcctcctctcacaagtccgttgcttccgaatccactgctggggagggatgagtgatgactctccgggcagggagctgccgaggccagagatgcccatgttcctggggttggcttttgccacccagtaccggatagtggacctgctggtggaagccgccgggcccggccaggatcgtcgcatggaatttctggtggagcctgtccccaaggaagggttccgggtacctcaggccgagtggggcagggcagttctgctttattcagcccctgcatgagcggatgctaaggccgggtggtctcctggcctcgggctgaggcctcttcccggctgtctgcccctggcctgcgctggacctgctaagtgcccacagtggcagcgaggtcccggtcccggggctggggtgggagaccccgggctgagtgctgtggctttctggtggggggcgatggaaacaggaaaccaagcagtgggatcgcagcgttggtcactgcgaggcgagtggcgggctttctgtttctgccttgtccctccccacggtacctggttcccaggtgaaaatgaaaggaggggagaagttgagaacagaacattccataaaggatatttcctaataggctgcaa

SEQ ID NO: 129672 - DNA, 1381 bp, Homo sapiens
  Payload ID: 5357
  Gene Symbol: ENGASE
  Gene Name: endo-beta-N-acetylglucosaminidase
  ENST ID: ENST00000578419
  CDS Start-End: 7-447
agtgtcatggaggccgcggcggtgacggtcacccggtcggctacacggcggcggcggcggcagctgcaggggctggcggccccggaggcggggacgcaggaggagcaggaggatcaggagccgcggccgcggcggcggcggccgggaaggagcatcaaagatgaagaagaagagacagtctttcgagaggtggtcagtttttccccggaccccctgccagttagatattatgacaaggacaccaccaaaccaatcagcttttacttgtcttcgctggaggagctcttggcgtggaagccccgcttggaggatggctttaatgtggccctggagcccctggcgtgtcgccagccccctctgagcagccagaggccccggactttgttgtgtcatgacatgatgggcgggtacctggatgacagggactttcatcacggagtggaatgaagggggaaggctctgtgaagccttcctggccggggatgagcgctcgtaccaggcagtggctgaccggctggtccagatcactcagttttttcgttttgatggctggctgatcaacatcgagaactcgctgagtctggccgctgtggggaacatgcctcctttcctgcggtacctcaccacacagctgcaccggcaggtcccagggggcctggtgctctggtatgacagcgtggtgcaaagtgggcagctcaaatggcaagacgaactcaaccagcacaacagggtcttctttgattcctgcgacggcttcttcactaactataactggcgggaggagcacttggagcggatgctggggcaggctggggagcgccgggctgatgtgtacgtgggcgtggatgtgtttgctcgagggaacgtggtcggaggccgattcgacacagacaaggtgggtggtggctttcgtccaagggccagcggcccagtgcctcccctgggacctcatttcctcatggaccttccattcccgtctgcacctcaaaggaatgacagcagctgttcttcccagagtggggatcccgtggcactgagaaacaggtgtcctgccccggccaagctatgtccccactgaaacccctttcccggctatttctacaatcagataatgtatttttgtgtgggtgttaccagacagaggcgcgtcgttcccccgctgtccggtcctcggcgggcctgggcctcctgtcccagctgcgttccttgatcttccccgtgagggaagcctgcggggacgcacaggggcctgcagcgcctctcactgcggctcaggggcgaggacgggggaggtgcccagggtttggggatcggtaggtgtcatgacgagggagcattttctggcaaggcaggtcacaccagcacagaggaaggagcgggg

SEQ ID NO: 129673 - DNA, 1208 bp, Homo sapiens
  Payload ID: 5358
  Gene Symbol: EBLN1
  Gene Name: endogenous Bornavirus-like nucleoprotein 1
  Uniprot ID: P0CF75
  ENST ID: ENST00000422359
  CDS Start-End: 39-1139
acaaaattgtgtgaaaatcacagaaacaatcacccacaatgtcccgcccaagaaacaacccacagaccagcagcccacaagacagtacaaaggatgggagcagcttccattactttcaagggagatttgagctctctgggaagagcagacagtatccagcagatgcattggagccccaacctggtattggagatgttaaggtcattgaaaaagcaactaagtctatgctagacccagcacagagatctcatttttaccttgtaaccccaagcttagtatttttgtgttttatattcgatggattacacaaggcactactcagtgtcggtgtgagcaaaaggtctaatattgtgattgggaatgagaacaaggaaacaggtactctctatgctagcaaatttgaagatgttttgcctaccttcactgcccttgagatgtcatcaattctgcgtcactgctgtgatctgataggcattgctgccggatcgagtgacccgatatgcaccaacagcctccaagtacagagacaattcaaggcaatgatgatatccattggaagacctttgcatagtgaaagtgctgatttattaattagctataatgcagggccagctatagattggatcaactcaagaccatgggttggaggattaatgttcacatttctatttggagaatttgaatcccctgcgtgcgagctacttgatcaagttaaagtagttgccagcaaagcacagatgatgacctactacactgtgagaatgttcctggatcagtgtgtggatggttccactgctttacccgctgttgtgttggagattccagtttttgagcagaagaaaccactggctaaaaaggtacttggagatttctttgaatttgggggtgtacttcgccaccctgttattggggtgctatcaccacaaatgttcccaaacctagcaacagcagcaaactactgggccaaaagaaggaattccacattttctggatttgaagcccttgacattataccaggatcaactattacattccctgtacttcaaatggcatctgctcagaaaatctccagaggaagtgacatggatccatatacacttaacatccttcgcggttatgggatttcgggatttgaataacaaatacgtgaactaatccttatatatacatataaaaagaaattatgtgaaaatcacattctaaaatag

SEQ ID NO: 129674 - DNA, 1679 bp, Homo sapiens
  Payload ID: 5359
  Gene Symbol: EBLN2
  Gene Name: endogenous Bornavirus-like nucleoprotein 2
  Uniprot ID: Q6P2I7
  ENST ID: ENST00000533473
  CDS Start-End: 424-1242
gaaaggcagggaggggaggttgtcccctgctgagaaccattggtttaaggttaatctggctctgctttcatagactactctgttacccaggctggagtgcggtgatgagtgatcatagctcactgcagccttaaactctagtgatcctcccgccttggccttccaaagtgctgagattacagatgtgaaccaccacacccagcccagtcaatttgtttttagaatgttcccaagaatatagttatgttgctaaataagatactaaaataatcccatactatatttcttgacagaaaaactattaaaatgtatacatgataaaaatttcttttatgaagcaaaatatgttttgttttgctcatgaacgtgaggtattttggaaaaatggtaaagaagtgcagagtcaagtcatagcgactaataatgggttattttcttaaattgtatgcttatgttaattctcacagtctttttgtttgggtctgtgacagatcttacaaaagatcttttagacctatgattcttaacaaaattaaagaattaagtcggaaccaattttccacaatgtctcatctaagaaaggactcacagcccagcagcccaggagatgacgcaatggacaggagtgggctccctgaccttcaaggaagatttgagctatctgggaaaaacagacagtatccactggatgcattggaaccccaacccagcattggggatattaaggacattaaaaaagcagccaagtctatgctagacccagcacataaatctcatttccaccctgtgaccccaagtttagtattcttgtgtttcatatttgatgggttacaccaggcattactgagtgttggtgtgagcaagaggtctaatactgtggttgggaatgagaacgaggaaaggggtactccttatgctagcagattcaaagatatgcctaactttattgcccttgagaagtcatcagttctccgccactgctgtgaccttttgataggcattgcggctggatcaagtgataagatttgcaccagcagtctccaagttcagagacgattcaaggcaatgatggcatctattggaagactttcacatggtgagagtgctgatctgctaatcagctgcaatgcagaatcagccataggttggatcagctcaagaccatgggttggagaattaatgttcacacttctatttggagactttgaatcccctctacacaagctacgcaagtcaagttagttgccaagaaagcacagatgacaacctattaatgctgtgagaatgtttctagatcagtgcatggatggctccattgctctacgggccattgtgtctgagatcccagtctttgaggagaaaaaaaacaatggttaaaaaggcattggggaaatattttgagtttgggggtgtactttgccaccccattattggggagctgtcaccacgaatgttcccaaacttagcaacagcggcaaactactgggccaagatgagcaaccccacatttttgggatttaaagctcctgatgttataccaggatcaaccatcacactccctttgcttcaaatggcatctaccccgtaagatcttgaggggggagtgttgggtggaatcatagatccatgcactcctaacatgaactaattctcattatttaaaaaaaaaaaaaaaaaaa

SEQ ID NO: 129675 - DNA, 2719 bp, Homo sapiens
  Payload ID: 5360
  Gene Symbol: ERV3-1
  Gene Name: endogenous retrovirus group 3, member 1
  Uniprot ID: Q14264
  ENST ID: ENST00000394323
  CDS Start-End: 502-2316
ttcactgctctgtgtcttctgctcctagaggcccagcttctgtggcctcgttacctgcaggtattgggagatccacagctaagacgccaggacccactggaagcctagaaatgttgcaggaattgtgccttggatccatccatccagtcagctgaaaccagcagcccaggacaagtggaccagccaacaggacctagaccatgcaacccagctgatcctacgatggaaccaaggtgccagtgagatgacaacagccctgctctggtcactccggaagctgaccagtccacacacggctgaagcttgaggagacaacagccctgctctagtcaccccagaagctgactagtctatgcacggccgaagcttgagtcatcatcagggaagtaaatgtggttagaaatctgaagtccagtaattttccttgtcatattaattactttgctattaagctgtcactttgcttagccttctccccccaggaaaaagccttttctgtccatgctgggtatgaacatgctactcatcactttgttcttgctactccccttatccatgttaaaaggagaaccctgggagggatgcctccactgcacccacactacgtggtcggggaacatcatgactaaaaccctgttgtatcacacttattatgagtgtgctgggacctgcctaggaacttgtactcacaaccagacaacctactcagtctgtgacccaggaaggggccagccttatgtgtgttatgaccctaagtcttcacctgggacctggtttgaaattcatgtcgggtcaaaggaaggggatcttctaaaccaaaccaaggtatttccctctggcaaggatgtcgtatccttatactttgatgtttgccagatagtatccatgggctcactctttcccgtaatcttcagttccatggagtactatagtagctgccataaaaataggtatgcacaccctgcttgttccaccgattccccagtaacaacttgctgggactgcacaacgtggtccactaaccaacaatcactagggccaattatgcttaccaaaataccattagaaccagattgtaaaacaagcacttgcaattctgtaaatcttaccatcttagagccagatcagcccatatggacaacaggtttaaaagcaccgctaggggcacgagtcagcggtgaagaaattggcccaggagcctatgtctatctatatatcataaagaaaactcggacccgctcaacccaacagttccgagtttttgagtcattctatgagcatgttaaccagaaattgcctgagccccctcccttggccagtaatttattcgcccaactggctgaaaacatagccagcagcctgcacgttgcttcatgttatgtctgtgggggaatgaacatgggagaccaatggccatgggaagcaagggaactaatgccccaagataatttcacactaaccgcctcttccctcgaacctgcaccatcaagtcagagcatctggttcttaaaaacctccattattggaaaattctgtattgctcgctggggaaaggcctttacagacccagtaggagagttaacttgcctaggacaacaatattacaacgagacactaggaaagactttatggaggggcaaaagcaataattctgaatcaccacacccaagcccattctctcgtttcccatctttaaaccattcttggtaccaacttgaagctccaaatacctggcaggcaccctctggcctctactggatctgtgggccacaagcatatcgacaactgccagctaaatggtcaggggcctgtgtactggggacaattaggccgtccttcttcctaatgcccctaaaacagggagaagccttaggataccccatctatgatgaaactaaaaggaaaagcaaaagaggcataactataggagattggaaggacaatgaatggcctcctgaaagaataattcaatattatggcccagccacctgggcagaagatggaatgtggggataccgcaccccagtttacatgcttaaccgcattataagattgcaggcagtactagaaatcattaccaatgaaactgcaggggccttgaatctgcttgcccagcaagccacaaaaatgagaaatgtcatttatcaaaatagactggccttagactacctcctagcccaggaagagggagtatgcggaaagttcaaccttactaactgctgcctggaacttgatgacgaaggaaaggtcatcaaagaaataactgctaaaatccaaaagttagctcacatcccagttcagacttggaaaggatagtctccagattcccttttcagaggttggttctcatcccttggaggatttaaaaccttagtacaaatagtcctagccatattgggagtttgccttatactcccttgtctcttacccctcattgtcaaaaatatccaaacagccatagaggctcttgtggacagacggactaccacacgactaatggccctaactaagtattaacccctgccaagaaaagagctacttcctcttgaagtaaatgaagatagtgatgctttctcttaaactttacttataaaaagcatcaaaggggggaatgaagcaggaaatataaaaggaaaaacaagtaaagggaaaacaagtcctttcctgaccagtctgactcactccaaagtcctgctggagctatgataattatctgcaa

SEQ ID NO: 129676 - DNA, 3198 bp, Homo sapiens
  Payload ID: 5361
  Gene Symbol: ERVFRD-1
  Gene Name: endogenous retrovirus group FRD, member 1
  Uniprot ID: P60508
  ENST ID: ENST00000472091
  CDS Start-End: 377-1993
gaacagggcacttggatctctcaaatggtgcagtgactcggataccttccctagtgccattacagtactggagactgccagctagatccatcacacccaagtgaagctgtggaaaagcccttaaactccagagccagaaccagcaacctcagctccggaatacacttgcaaggcactggaagatctaaaattcctctttaaacaaaaagataagtaatgccccaccaacatcctttcacctcaaagtaaggtgatcccaatactagaaattttactggcaattgctctgattgttatcactattttaaccctaacttgtacaccaccaggagttccattggcagctcgttttgtgaccagtttctcttaggtcaccatgggcctgctcctgctggttctcattctcacgccttcactagcagcctaccgccatcctgatttcccgttattggaaaaagctcagcaactgctccaaagtacaggatccccttactccaccaattgctggttatgtactagctcttccactgaaacaccagggacagcttatccagcctcgcccagagaatggacaagcatagaggcggaattacatatttcctatcgatgggaccctaatctgaaaggactgatgaggcctgcaaatagtcttctttcaacagtaaagcaagatttccctgatatccgccagaaacctcccattttcggacccatctttactaatatcaacctaatgggaatagcccctatttgtgttatggccaaaaggaaaaatggaacaaatgtaggcactcttccaagtacagtctgtaatgttactttcactgtagattctaaccaacagacttaccaaacatacacccacaaccaattccgccatcaaccaagattccccaaacctccaaatattacttttcctcagggaactttgctagataaatccagccggttttgccagggacgcccaagctcatgcagtactcgaaacttctggttccggcctgctgattataaccaatgtctgcaaatttccaacctcagctctacagcggaatgggttctattggaccaaactcgaaattctcttttttgggaaaataaaaccaagggagctaaccagagccaaacaccctgcgtccaagtcttagcaggcatgactatagccaccagctacctgggcatatcagcagtctcagaattttttggaacctccctcacccccttatttcatttccatatctctacatgccttaaaactcaaggagccttttatatttgtggccagtcgattcaccaatgcctccccagtaactggactggaacttgtaccataggctatgtaaccccagacatcttcatagcccctggcaatctctctcttccaataccaatctatgggaattccccgttgcccagggtgaggagggcaatccatttcattccccttctcgcgggactcggcattctagctggtacgggaaccggaattgctggaatcacaaaagcttccctcacctatagccagctctcaaaggaaatagccaacaacattgacaccatggctaaagccttaacgaccatgcaagaacaaatcgactctttagcagccgtagtccttcaaaatcgtcgaggactagacatgttaacggcagcacagggaggaatttgtttggccttagatgaaaaatgttgcttttgggtaaatcaatcaggaaaagtacaagacaacatcagacaactcctaaatcaagcctccagtttacgggaacgagccactcagggttggttaaattgggaaggaacttggaaatggttctcttgggttcttccccttacaggcccacttgttagtctcctacttttgctcctttttggtccatgtctcctaaatctaataacccaatttgtctcctctcgccttcaggccataaagctccagacgaatctcagtgcaggacgccatcctcgcaatattcaagagtcacccttctaaggaggacccctagactgctcgctagtggaacacgacagaggcgaaatcctgccccgtctcccgtggacctggctggatatggtttttgccaatccacagagccatcctgccctgacagctagcaagaggccaagacccacagaacaaccactacagcccctctgtcagcaggaagcagttaaagaagactgaccttcgtccattttcccagataattgggtcttggactcttgagggggggaaatgttggagcaggtagctagtcagacatgagcagggcaggggagggccccctcaccaggaatgtcaggcaaccatcaggtgatggtgaggcagttgttaagctgtgtctctaacataataatgagtggcagctggcgccagggaacgatggcctcccaatagataggaaacacctgaagctggtgatcagccacttcctgataagatctcaggagttgggtgcgcaggctcaagcatgcaccctaagaggcaaaatagtggcatttaactcatatatgaccttcctttaggaaggcttgactggtaagggaaaaactcctccagtgaacacgtgcacaacttcagtaaaaacactgcacatgcgtcccctcccaagtgctggcaggccactgtgcatgcagacagcccgccccaaagaaaaatcagaggaggagaaatggaaaccccggaacaatgccaatgtataaaaccccaagtcaagggcctaccaaggcaattggatctctcaagtcacccgcttggctctcttcaagtgcactttgcttccttttgttcttgctctaaaacttttactcctgctataaaacttgccttggactatcatgctaccttacgcctccccggccaaattccctcctctcctccggggggcaaggatggagtctgctgcagacccattggatttgctgctggtaacagttccaccatttaggttccagcaccaagcaaactaacacccgactcagtgtaaacagccaaacaagcttaaccaattagaaaccaccatctaacctctaactaggtcctttcaactttaaccaagtattttctttgtcttgcttctgtgggaaccttataaaattttcccccttgtacctctgtagtagagacccagttgcttgcagtttggccctgcctgttcatgaatcacccttgctcaaataaactctctaaaatgctaa

SEQ ID NO: 129677 - DNA, 3184 bp, Homo sapiens
  Payload ID: 5361
  Gene Symbol: ERVFRD-1
  Gene Name: endogenous retrovirus group FRD, member 1
  Uniprot ID: P60508
  ENST ID: ENST00000542862
  CDS Start-End: 365-1981
tatttgaaagggccccttcaccattctattatctacccctacagccattacagtactggagactgccagctagatccatcacacccaagtgaagctgtggaaaagcccttaaactccagagccagaaccagcaacctcagctccggaatacacttgcaaggcactggaagatctaaaattcctctttaaacaaaaagataagtaatgccccaccaacatcctttcacctcaaagtaaggtgatcccaatactagaaattttactggcaattgctctgattgttatcactattttaaccctaacttgtacaccaccaggagttccattggcagctcgttttgtgaccagtttctcttaggtcaccatgggcctgctcctgctggttctcattctcacgccttcactagcagcctaccgccatcctgatttcccgttattggaaaaagctcagcaactgctccaaagtacaggatccccttactccaccaattgctggttatgtactagctcttccactgaaacaccagggacagcttatccagcctcgcccagagaatggacaagcatagaggcggaattacatatttcctatcgatgggaccctaatctgaaaggactgatgaggcctgcaaatagtcttctttcaacagtaaagcaagatttccctgatatccgccagaaacctcccattttcggacccatctttactaatatcaacctaatgggaatagcccctatttgtgttatggccaaaaggaaaaatggaacaaatgtaggcactcttccaagtacagtctgtaatgttactttcactgtagattctaaccaacagacttaccaaacatacacccacaaccaattccgccatcaaccaagattccccaaacctccaaatattacttttcctcagggaactttgctagataaatccagccggttttgccagggacgcccaagctcatgcagtactcgaaacttctggttccggcctgctgattataaccaatgtctgcaaatttccaacctcagctctacagcggaatgggttctattggaccaaactcgaaattctcttttttgggaaaataaaaccaagggagctaaccagagccaaacaccctgcgtccaagtcttagcaggcatgactatagccaccagctacctgggcatatcagcagtctcagaattttttggaacctccctcacccccttatttcatttccatatctctacatgccttaaaactcaaggagccttttatatttgtggccagtcgattcaccaatgcctccccagtaactggactggaacttgtaccataggctatgtaaccccagacatcttcatagcccctggcaatctctctcttccaataccaatctatgggaattccccgttgcccagggtgaggagggcaatccatttcattccccttctcgcgggactcggcattctagctggtacgggaaccggaattgctggaatcacaaaagcttccctcacctatagccagctctcaaaggaaatagccaacaacattgacaccatggctaaagccttaacgaccatgcaagaacaaatcgactctttagcagccgtagtccttcaaaatcgtcgaggactagacatgttaacggcagcacagggaggaatttgtttggccttagatgaaaaatgttgcttttgggtaaatcaatcaggaaaagtacaagacaacatcagacaactcctaaatcaagcctccagtttacgggaacgagccactcagggttggttaaattgggaaggaacttggaaatggttctcttgggttcttccccttacaggcccacttgttagtctcctacttttgctcctttttggtccatgtctcctaaatctaataacccaatttgtctcctctcgccttcaggccataaagctccagacgaatctcagtgcaggacgccatcctcgcaatattcaagagtcacccttctaaggaggacccctagactgctcgctagtggaacacgacagaggcgaaatcctgccccgtctcccgtggacctggctggatatggtttttgccaatccacagagccatcctgccctgacagctagcaagaggccaagacccacagaacaaccactacagcccctctgtcagcaggaagcagttaaagaagactgaccttcgtccattttcccagataattgggtcttggactcttgagggggggaaatgttggagcaggtagctagtcagacatgagcagggcaggggagggccccctcaccaggaatgtcaggcaaccatcaggtgatggtgaggcagttgttaagctgtgtctctaacataataatgagtggcagctggcgccagggaacgatggcctcccaatagataggaaacacctgaagctggtgatcagccacttcctgataagatctcaggagttgggtgcgcaggctcaagcatgcaccctaagaggcaaaatagtggcatttaactcatatatgaccttcctttaggaaggcttgactggtaagggaaaaactcctccagtgaacacgtgcacaacttcagtaaaaacactgcacatgcgtcccctcccaagtgctggcaggccactgtgcatgcagacagcccgccccaaagaaaaatcagaggaggagaaatggaaaccccggaacaatgccaatgtataaaaccccaagtcaagggcctaccaaggcaattggatctctcaagtcacccgcttggctctcttcaagtgcactttgcttccttttgttcttgctctaaaacttttactcctgctataaaacttgccttggactatcatgctaccttacgcctccccggccaaattccctcctctcctccggggggcaaggatggagtctgctgcagacccattggatttgctgctggtaacagttccaccatttaggttccagcaccaagcaaactaacacccgactcagtgtaaacagccaaacaagcttaaccaattagaaaccaccatctaacctctaactaggtcctttcaactttaaccaagtattttctttgtcttgcttctgtgggaaccttataaaattttcccccttgtacctctgtagtagagacccagttgcttgcagtttggccctgcctgttcatgaatcacccttgctcaaataaactctctaaaatgct

SEQ ID NO: 129678 - DNA, 922 bp, Homo sapiens
  Payload ID: 5362
  Gene Symbol: ERVK3-1
  Gene Name: endogenous retrovirus group K3, member 1
  ENST ID: ENST00000427361
  CDS Start-End: 279-503
ggcagtgtgtaagacgctcacgggcgcgcggactatcgggcggctaggctctctgaggaggctgccacagtgaagcaaccgtgacaagtggtgcccgaccagggacctgaacgaggaaggtctgccagagcagagaaagtgaaactgatcagacgaactacgaacccctggacgggagagtctgccggcggagaatataaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaacccctgactccatgttcttggccatgctagctgtagtgtcctgtgcgtctataggatcgggtgaaccaccaaccggcaattgaaagctgcacagcctgaaattacctttattcaattaatgcaaaaacaaaaggggagatgttggaggccgaaggaatgagggtcgtgaccaactcagtataccactggaggctctgtgagcaaacagcaaactgttctcatgaaagcaggatgttggcgaactgacaaactctgtctgccgccagaaggaatgctgggggcagtcatgtcccaggtcccgtgctccttgaggttatccacaggaacatccagaacctgttgaacaaagaaaggaatcatgtgggcctgtgttaaatcaaatagctgaccgacagttatcccttcctccctattcactctacctaataaatatgaagggctgtaaaagctcaggtccctgttccctaatatcaaggagccccctgaccccttctttcaaaca

SEQ ID NO: 129679 - DNA, 1469 bp, Homo sapiens
  Payload ID: 5362
  Gene Symbol: ERVK3-1
  Gene Name: endogenous retrovirus group K3, member 1
  ENST ID: ENST00000413518
  CDS Start-End: 260-589
gaggtcctgggcggccgctggccaccaggcggaagtgcgtaccggaagtgccggcggcagtgtgtaagacgctcacgggcgcgcggactatcgggcggctaggctctctgaggaggctgccacagtgaagcaaccgtgacaagtggtgcccgaccagggacctgaacgaggaaggtctgccagagcagagaaagtgaaactgatcagacgaactacgaacccctggacgggagagtctgccggcggagaatataaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaacccctgactccatgttcttggccatgctagctgtagtgtcctgtgcgtctataggatcgggtgaaccaccaaccggcaattgaaagctgcacagcctgaaattacctttattcaattaatgcaaaaacaaaaggggagatgttggaggccgaaggaatgagggtcgtgaccaactcagtataccactggaggctctgtgagcaaacagcaaactgttctcatgaaagcaggatgttggcgaactgacaaactctgtctgccgccagaaggaatgctgggggcagtcatgtcccaggtcccgtgctccttgaggttatccacaggaacatccagaacctgttgaacaaagaaaggaatcatgtgggcctgtgttaaatcaaatagctgaccgacagttatcccttcctccctattcactctacctaataaatatgaagggctgtaaaagctcaggtccctgttccctaatatcaaggagccccctgaccccttctttcaaacagatccttttgtctgtctcatttctgcattcgtcgtccttcgttcggtccagaagcaaccgcgacagtcctgcatgtgttgatgccacctgtatgtgcaggtgtgacctcaggtgtgtgagtatccctcataccccttatcatcactgcctattcgctcttcctccagcctctggcaaccactaatccacgttatatgtctagatttgcctcttctggacacttcatataaatggagtcatacaatatgtggtttcttgtgtctggctttttaccactgaacgttttcagagttcatccatgttgtagcatgtatcagtttttcattcctctttatggctgaataatactgcattgtatggatataccacagtttgtttactcattagttcatagacattggggttgtttccaactctctgatattataaatgctactgctgtgaaaattcatgtacaggtg

SEQ ID NO: 129680 - DNA, 564 bp, Homo sapiens
  Payload ID: 5362
  Gene Symbol: ERVK3-1
  Gene Name: endogenous retrovirus group K3, member 1
  ENST ID: ENST00000608070
  CDS Start-End: 326-564
agtgtgtaagacgctcacgggcgcgcggactatcgggcggctaggctctctgaggaggctgccacagtgaagcaaccgtgacaagtggtgcccgaccagggacctgaacgaggaaggtctgccagagcagagaaagtgaaactgatcagacgaactacgaacccctggacgggagagtctgccggcggagaatataagaccccagcagaacgacactggcaactgctagaggaaaagaggcaagtttatccaaaagtgttatggaaatccccagaagaaggacaatggaaaggtccggtggatttgctgacgtggggacgagggtatgcttgtgtttttacaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaa

SEQ ID NO: 129681 - DNA, 501 bp, Homo sapiens
  Payload ID: 5362
  Gene Symbol: ERVK3-1
  Gene Name: endogenous retrovirus group K3, member 1
  ENST ID: ENST00000608004
  CDS Start-End: 245-501
aagcaaccgtgacaagtggtgcccgaccagggacctgaacgaggaaggtctgccagagcagagaaagtgaaactgatcagacgaactacgaacccctggacgggagagtctgccggcggagaatataagcccgtgtcctctgtctcttgcttcggcgcctggatggcttgccgcccacacaagagcaccttaaaaccagaactgcttaacctatttctgagactccaaaaagctgttcgctctcatgctgccccttttcatatttctcatatccgatctcacacacaacttcctggggccactatctctagaccccagcagaacgacactggcaactgctagaggaaaagaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggcc

SEQ ID NO: 129682 - DNA, 536 bp, Homo sapiens
  Payload ID: 5362
  Gene Symbol: ERVK3-1
  Gene Name: endogenous retrovirus group K3, member 1
  ENST ID: ENST00000609864
  CDS Start-End: 243-536
agtgtgtaagacgctcacgggcgcgcggactatcgggcggctaggctctctgaggaggctgccacagtgaagcaaccgtgacaagtggtgcccgaccagggacctgaacgaggaaggtctgccagagcagagaaagtgaaactgatcagacgaactacgaacccctggacgggagagtctgccggcggagaatataagaccccagcagaacgacactggcaactgctagaggaaaagaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaacccctgactccatgttcttggccatgctagctgtagtgtcctgtgcg

SEQ ID NO: 129683 - DNA, 669 bp, Homo sapiens
  Payload ID: 5362
  Gene Symbol: ERVK3-1
  Gene Name: endogenous retrovirus group K3, member 1
  ENST ID: ENST00000610038
  CDS Start-End: 321-669
gcagtgtgtaagacgctcacgggcgcgcggactatcgggcggctaggctctctgaggaggctgccacagtgaagcaaccgtgacaagtggtgcccgaccagggacctgaacgaggaaggtctgccagagcagagaaagtgaaactgatcagacgaactacgaacccctggacgggagagtctgccggcggagaatataagcagaacgacactggcaactgctagaggaaaagaggcaagtttatccaaaagtgttatggaaatccccagaagaaggacaatggaaaggtccggtggatttgctgacgtggggacgagggtatgcttgtgtttttacaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaacccctgactccatgttcttggccatgctagctgtagtgtcctgtgcgtctataggatcgggtgaaccaccaaccggcaatt

SEQ ID NO: 129684 - DNA, 2744 bp, Homo sapiens
  Payload ID: 5363
  Gene Symbol: ERVMER34-1
  Gene Name: endogenous retrovirus group MER34, member 1
  Uniprot ID: Q9H9K5
  ENST ID: ENST00000440542
  CDS Start-End: 741-2432
tcttggtcttctggcctggcggcgatcgtcggccagtttatccctcggagttgcactggcagacacgccgctactttgtagcgggtttcgggcgggccacgcgtgcggcgacaggaacccaaccccggccgaccttgggctccaggaattcgttgtctacgtctgcggaggtgcggcagcctcagttttaagcgcaggaaggcaatagaggctgtgctctgaacctttccctcacgatgatcttctgcctgttgaccatcctggtgtctttcccatgtggccctgtatggttggcatggttcctgtctttaggacttgtgatcaagtatatctgaaagtttttagaagaaaagatgtgttgtaacctccctggaaaaagaagagaccttatgaagtactgctaaccacctacatagtcatcaaaataaaattcctgaatttgtacaagccacaggaagctagattgagatcattatatgacaactggaaggccaaggctatgggttacctcaaattgaggaattttggcacctactcacaggctccatgagcagatgaagtagacagctttactcagtatctcagaccaagaacttcatctccatctccaactagctgaaacatcttccctcctcaacctggaaaattctctgacttagaaatttaaacaaaaccctcccctttcattgaatctccattgtctggagtttgcttgttttaatctagcctgttcctccactatgggctccctttcaaactatgccctgcttcaactaacccttactgcttttttgacaattctagtacaacctcagcacctgcttgctccagttttccggacactatctatcttgactaatcagtctaattgctggttatgtgaacatctagataatgcagaacaacccgaactagtttttgttcctgccagtgcaagcacctggtggacctattctggacaatggatgtatgaaagggtgtggtatccacaagcagaagtacagaatcactctacttcctcctatcgtaaagtgacttggcactgggaagcctccatggaagctcaaggtctatcctttgctcaagtaaggttattggagggaaatttttctctttgcgtagaaaataaaaatggcagtggacccttcctaggtaatatacctaaacaatactgtaatcaaatactatggtttgattctacagatggcaccttcatgccctctatagatgttacaaatgaatccaggaacgatgatgatgatacaagtgtttgcctaggcactagacaatgttcctggtttgcaggttgcacaaaccggacctggaacagctcagctgttcccttgattggtctgcccaatacccaagactacaaatgggtagatcgaaattctggattgacctggtcaggtaatgacacctgtctctatagctgccaaaaccaaaccaaaggccttctgtaccagctatttcgcaacctattttgctcttatggcctgacagaggcacatgggaaatggagatgtgcagatgccagcataactaatgacaaaggtcatgatggacaccggacccccacctggtggctcacaggttccaatctgaccttgtctgtgaacaactctggcctcttttttttgtgcggcaatggggtgtacaaagggtttccacctaaatggtctgggcgatgtggacttgggtatcttgtaccttccctcaccagatacctcaccttaaatgctagccaaattacaaacctgagatccttcattcataaagtaacaccgcatagatgcacccaaggagacacagacaatccacctctgtattgcaaccccaaggacaattcaacaataagggccctttttccaagtttgggaacttatgatttagaaaaggcaattctaaacatttccaaagcaatggaacaggaattcagtgccactaagcagaccttggaagcacaccaatcaaaagttagcagtttagcctctgcatcccgaaaggatcatgtcttggatataccgaccacccaacgacaaacggcttgtggaactgttggcaaacagtgttgcctctatataaattattcggaagaaataaagtctaatatacagcgtctccacgaagcatccgagaacctgaagaatgtaccgttacttgattggcaaggcatatttgcaaaagtgggagactggttcagatcatggggctatgtgcttttaattgttcttttctgcttattcatctttgttttaatctatgttcgtgtctttcgcaaatctcgcagatcccttaactcccaacctctgaacctagccttatctccacagcaatcagcacagctccttgtcagtgaaacttcatgtcaagtttcaaatagggcaatgaagggactaacaacccatcaatatgacacaagtctactttgagaatatctgaacaaacagcagctgcagacaaaaagccttagctaaactttgatgagtaaagcaggtcttaccgagaattcagctgccaaaaccctcctctgagtgttcctcttataagggcacttagcactaggacctcccaaggtattgtaaataagccttatcagaactttttgtagtttcattctgaagccttaagacacacaccataaagctgatctgtaaacccttaccccttgctgttcagagagctactctttgtagtgttcttgcatgcatatataataaatgttttttctattgatctgttaa

SEQ ID NO: 129685 - DNA, 3830 bp, Homo sapiens
  Payload ID: 5363
  Gene Symbol: ERVMER34-1
  Gene Name: endogenous retrovirus group MER34, member 1
  Uniprot ID: Q9H9K5
  ENST ID: ENST00000443173
  CDS Start-End: 862-2553
agagtcttccctgcgccgaaagcgcaggtatgttcctagtcttgagcgggagaaaatcacccagctcggagcacctggccagtgggaccggtgggttcctggtgcctgaatccggctgtccgctctgcggtgccccgccccgccccaacccaggatcttcccagccccgctccgccccaacccaggatcttcccagccctcgtgtgtccccgctcacttcagttcccgccgcgagccttcttcttggtcttctggcctggcggcgatcgtcggccagtttatccctcggagttgcactggcagacacgccgctactttgtagcgggtttcgggcgggccacgcgtgcggcgacaggaacccaaccccggccgaccttgggctccaggaattcgttgtctacgtctgcggaggtgcggcagcctcagttttaagcgcaggtgatcaagtatatctgaaagtttttagaagaaaagatgtgttgtaacctccctggaaaaagaagagaccttatgaagtactgctaaccacctacatagtcatcaaaataaaattcctgaatttgtacaagccacaggaagctagattgagatcattatatgacaactggaaggccaaggctatgggttacctcaaattgaggaattttggcacctactcacaggctccatgagcagatgaagtagacagctttactcagtatctcagaccaagaacttcatctccatctccaactagctgaaacatcttccctcctcaacctggaaaattctctgacttagaaatttaaacaaaaccctcccctttcattgaatctccattgtctggagtttgcttgttttaatctagcctgttcctccactatgggctccctttcaaactatgccctgcttcaactaacccttactgcttttttgacaattctagtacaacctcagcacctgcttgctccagttttccggacactatctatcttgactaatcagtctaattgctggttatgtgaacatctagataatgcagaacaacccgaactagtttttgttcctgccagtgcaagcacctggtggacctattctggacaatggatgtatgaaagggtgtggtatccacaagcagaagtacagaatcactctacttcctcctatcgtaaagtgacttggcactgggaagcctccatggaagctcaaggtctatcctttgctcaagtaaggttattggagggaaatttttctctttgcgtagaaaataaaaatggcagtggacccttcctaggtaatatacctaaacaatactgtaatcaaatactatggtttgattctacagatggcaccttcatgccctctatagatgttacaaatgaatccaggaacgatgatgatgatacaagtgtttgcctaggcactagacaatgttcctggtttgcaggttgcacaaaccggacctggaacagctcagctgttcccttgattggtctgcccaatacccaagactacaaatgggtagatcgaaattctggattgacctggtcaggtaatgacacctgtctctatagctgccaaaaccaaaccaaaggccttctgtaccagctatttcgcaacctattttgctcttatggcctgacagaggcacatgggaaatggagatgtgcagatgccagcataactaatgacaaaggtcatgatggacaccggacccccacctggtggctcacaggttccaatctgaccttgtctgtgaacaactctggcctcttttttttgtgcggcaatggggtgtacaaagggtttccacctaaatggtctgggcgatgtggacttgggtatcttgtaccttccctcaccagatacctcaccttaaatgctagccaaattacaaacctgagatccttcattcataaagtaacaccgcatagatgcacccaaggagacacagacaatccacctctgtattgcaaccccaaggacaattcaacaataagggccctttttccaagtttgggaacttatgatttagaaaaggcaattctaaacatttccaaagcaatggaacaggaattcagtgccactaagcagaccttggaagcacaccaatcaaaagttagcagtttagcctctgcatcccgaaaggatcatgtcttggatataccgaccacccaacgacaaacggcttgtggaactgttggcaaacagtgttgcctctatataaattattcggaagaaataaagtctaatatacagcgtctccacgaagcatccgagaacctgaagaatgtaccgttacttgattggcaaggcatatttgcaaaagtgggagactggttcagatcatggggctatgtgcttttaattgttcttttctgcttattcatctttgttttaatctatgttcgtgtctttcgcaaatctcgcagatcccttaactcccaacctctgaacctagccttatctccacagcaatcagcacagctccttgtcagtgaaacttcatgtcaagtttcaaatagggcaatgaagggactaacaacccatcaatatgacacaagtctactttgagaatatctgaacaaacagcagctgcagacaaaaagccttagctaaactttgatgagtaaagcaggtcttaccgagaattcagctgccaaaaccctcctctgagtgttcctcttataagggcacttagcactaggacctcccaaggtattgtaaataagccttatcagaactttttgtagtttcattctgaagccttaagacacacaccataaagctgatctgtaaacccttaccccttgctgttcagagagctactctttgtagtgttcttgcatgcatatataataaatgttttttctattgatctgttaatttgcaagcccccaaacactggaactaagttgggggcaggatagtttctcccaacagcactttgtaggcttctggatagaccaaagagtgtgtttgaatagataagggaattttgttcccttgattttggttgaaggtagaagaatccaatgtacacatacacaaaactatgtccttaaatttgtctcaaagaataaatattgggtagtcatcagaattgactgaaaacttactttagggagaaagccacaaataatttaggctggtatgatctgagctttcctgatttcccatgggcattttagtggtctaatggaatattagtctgatatgcattttagccatcttatgaaatgggccgcaggtggaagtaggatgcagggagtgttgaggtggcatctattatatcaaatgcttcactctgcccagtcctctggtgagttccttacatgcatctttctagttaatcctctcggtgttcatattttacagattaatcaactcaaagggtagatagcttgctaaagattatactattactgaaaaatagcaagatgcagaacagcatacctagtatgttactcttttttttttttttttgaggcagagtctggccctttcacccaggctggagtgcagtggctcaatctcggctcactgcaacctctgcccccttgggttcatgccattctcctgcctccctcctgagtagctgggactacaggcgcctgccaccacgcctgactaattttttgtgtttttagtagagacggggtttcaccgtgttagccaggatggtctcagtctcctgacctcatgacccgcccacctcaacctcccaaagtcctaggattataggtgtgagccactgcacccagcctcgtatgttactttttattttaaaaaaggggaaatgatatgtatatgtgtatgtatttgcaaataaaacaggaaaagccattcac

SEQ ID NO: 129686 - DNA, 2202 bp, Homo sapiens
  Payload ID: 5364
  Gene Symbol: ERVV-1
  Gene Name: endogenous retrovirus group V, member 1
  Uniprot ID: B6SEH8
  ENST ID: ENST00000602168
  CDS Start-End: 171-1604
tgcggtggcatcggttcttctccttattttgacccacactggcatgccacctgaagtcccgataacagcctgatttctcactaaacactccatcgaaccatttcattatttgtctctcctattttcagcactttccttttgctttcacaaagcttaagggagaatcagctatgacagagaaattccttttcctttatctttccctccttcccatgcccctactctcacaggcacagtggaatgaaaattcccttgtcagtttttccaaaataattgcttcgggaaaccatctaagcaactgttggatctgccacaacttcatcaccaggtcctcatcttaccaatatattttggtaagaaatttttctttaaacctaacatttggttcaggaatccctgaaggccaacataaatctgttccgctccaggtttcgcttgctaactcagcgcaccaagtcccctgcctggatctcactccacctttcaatcaaagctctaaaacttctttctatttctacaactgctcttctctaaaccaaacctgttgtccatgccctgaaggacactgtgacaggaagaacacctctgaggagggattccccagtcccaccatccatcccatgagcttctccccagcaggctgccaccctaacttgactcactggtgtccagctaaacaaatgaacgattatcgagacaagtcaccccaaaaccgctgtgcagcttgggaaggaaaagagctaatcacatggagggttctatatttgcttcccaaggcacacactgtccccacatggccaaaatctactgttcccctgggagggcctctatcccctgcatgcaatcaaactattccagcagggtggaaatcgcagttacacaagtggttcgacagccacatcccccggtgggcctgtacccctcctggctatgtatttttatgtgggccacaaaaaaataaactgccctttgatggaagtcctaagataacttattcaaccccccctgtggcaaacctctacacttgcattaataacatccaacatacgggagaatgtgctgtgggacttttgggaccacgggggataggtgtgaccatttataacaccacccaacccagacagaaaagagctctgggtctaatactggcagggatgggtgcggccataggaatgatcgccccatggggagggttcacttatcatgatgtcaccctcagaaatctctccagacaaatagacaacatagctaagagtaccagagatagcatctctaaactcaaggcctccatagattctctagcaaatgtagtcatgaacaacagattggccttagattacctcttagcagagcagggtggagtctgtgcagtgatcagtaaatcctgttgcatttatgtcaataacagtggggcgatagaggaggatataaaaaagatctatgatgaggttacgtggctccataactttggaaaaggtgattcagcagggtccatttgggaggctgtgaagtctgccctcccctccctcacatggtttgtccctttactgggaccagctgcacttaatagcctgctttctcctctttggcccttgtctctataattcactaattaaatatgtctcttccaggatatggcaatttcacacagagcccctaaaaatggaaagagatcatccaatcttccttggaggtcccagcacctacaagtacatatctcccttggatgccagtgggcaaagattctgcaactacggaggggctccttccctgacagagagcaagagagggagaccctgatgacttcttcgtcccacgtcagcaggaagtagttacagaagacccacgacgtccttatgcccaaagcttttcagggtctccaactcttgagggggaatactgttagggtaggcaggtagccagacaagagcaggcaaggaagcccctgggaaaggaatctttagaaatgcagcccgctgatggcctccttggaaacgctgcacgctgagtcagcaaaaggaggagcgtggctacactggctacacctggccttgtggctgcattcctctgttccagaagggaacttatcaaggcccagccagaggttaccaaggtaggagctattccccactaagaagcatgtatacttctctaataattcaccctaatataccattttgttcattaaaataataaaaaaaa

SEQ ID NO: 129687 - DNA, 2431 bp, Homo sapiens
  Payload ID: 5365
  Gene Symbol: ERVV-2
  Gene Name: endogenous retrovirus group V, member 2
  Uniprot ID: B6SEH9
  ENST ID: ENST00000601417
  CDS Start-End: 607-2214
acagactccttcttttcaggagcccactcggttctgtcgttcagggtgtcgcttctttctgagctcctgtctctttaaatgaagggcatttaccctttaactctttctgcgcatctcttgactgaatccaagaagaccaagaaccagaggacttccacacccctctgggtaacatctggtgttttcacctggttacctggttacctcgcctggttatccagctatcaacatttctggcatctccagttggatacatcagtctcaagtgaaactgtgggaaggtcccgaagaaccacagaagaacaacagaattcagcacctgagcattcttgtgagccactggagaacttaaaattccacttcaagtgaaaagataagtaaagccttctctctgttcacccaaaactaaagtcaatctcagtacggggaatcttggttgcggtggcattggttcttctccttattttgacccaactggcatgccacctgaagtcccgataacagcctgatttctcactaaacactccatcgaaccacttcattatttgtctctcctattttcagcactttccttttgctttcacaaagcttaagggagaatcagctatgacagagaaattccttttcctttatctttccctccttcccatgcccctactctcacaggcacagtggaatgaaaattcccttgtcagtttttccaaaataattgcttcgggaaaccatctaagcaactgttggatctgccacaacttcatcaccaggtcctcatcttaccaatatattttggtaagaaatttttctttaaacctaacatttggttcaggaatccctgaaggccaacataaatctgttccgctccaggtttcgcttgctaactcagcgcaccaagtcccctgcctggatctcactccacctttcaatcaaagctctaaaacttctttctatttctacaactgctcttctctaaaccaaacctgttgtccatgccctgaaggacactgtgacaggaagaacacctctgaggagggattccccagtcccaccatccatcccatgagcttctccccagcaggctgccaccctaacttgactcactggtgtccagctaaacaaatgaacgattatcgagacaagtcaccccaaaaccgctgtgcagcttgggaaggaaaagagctaatcacatggagggttctatattcgcttcccaaggcacacactgtccccacatggccaaaatctactgttcccctgggagggcctctatcccctgcatgcaatcaaactattccagcagggtggaaatcgcagttacacaagtggttcgacagccacatcccccggtgggcctgtacccctcctggctatgtatttttatgtgggccacaaaaaaataaactgccctttgatggaagtcctaagataacctattcaaccccccctgtggcaaacctctacacttgcattaataacatccaacatacgggagaatgtgctgtgggacttttgggaccacgggggataggtgtgaccatttataacaccacccaacccagacagaaaagagctctgggtctaatactggcagggatgggtgcggccataggaatgatcgccccatggggagggttcacttatcatgatgtcaccctcagaaatctctccagacaaatagacaacatagctaagagtaccagagatagcatctctaaactcaaggcctccatagattctctagcaaatgtagtcatggacaacagattggccttagattacctcttagcagagcagggtggagtctgtgcagtgatcaataaatcctgttgcgtttatgtcaataacagtggggcgatagaggaggatataaaaaagatctatgatgaggctacgtggctccatgactttggaaaaggaggtgcttcagcaagggccatctgggaggctgtgaagtctgccctcccctccctcaactggtttgtccctttactgggaccagcaacagttatactcttacttttcctctttggcccttgtttctttaatttactgattaagtgtgtctcttctaggataaagcaatttcacatgaagtccccccaaatggaaagatatcagctatctgtcattggaggccccagcacctataagcacatctcccccttggatgccagtgggcaaagattccgggaaactatggaggaattttctctctgagacagagcaagagagggagaccctgatgacttcttcgccccatgtcagcaggaagtagttacagaagacccacgacgtccttacaaccagagcttttcagggtctccatctcttgaggagggaaatattagggtaggcaggtaggcaggcatgagcaggcaagagagcccttgggaaaggaatctttagaaacgcagcccactgatagcttccttgg

SEQ ID NO: 129688 - DNA, 2925 bp, Homo sapiens
  Payload ID: 5366
  Gene Symbol: ERVW-1
  Gene Name: endogenous retrovirus group W, member 1
  Uniprot ID: Q9UQF0
  ENST ID: ENST00000493463
  CDS Start-End: 925-2541
ccctgccttatcgccaagctccttcaggagaacaaagaacaggccattaccctggagaagactggcaactgattttacccacaagcccaaacctcagggatttcagtatctactagtctgggtagatactttcacgggttgggcagaggccttcccctgtaggacagaaaaggcccaagaggtaataaaggcactagttcatgaaataattcccagattcggacttccccgaggcttacagagtgacaatagccctgctttccaggccacagtaacccagggagtatcccaggcgttaggtatacgatatcacttacactgcgcctgaaggccacagtcctcagggaaggtcgagaaaatgaatgaaacactcaaaggacatctaaaaaagcaaacccaggaaacccacctcacatggcctgctctgttgcctatagccttaaaaagaatctgcaactttccccaaaaagcaggacttagcccatacgaaatgctgtatggaaggcccttcataaccaatgaccttgtgcttgacccaagacagccaacttagttgcagacatcacctccttagccaaatatcaacaagttcttaaaacattacaaggaacctatccctgagaagagggaaaagaactattccacccttgtgacatggtattagtcaagtcccttccctctaattccccatccctagatacatcctgggaaggaccctacccagtcattttatctaccccaactgcggttaaagtggctggagtggagtcttggatacatcacacttgagtcaaatcctggatactgccaaaggaacctgaaaatccaggagacaacgctagctattcctgtgaacctctagaggatttgcgcctgctcttcaaacaacaaccaggaggaaagtaactaaaatcataaatccccatggccctcccttatcatatttttctctttactgttcttttaccctctttcactctcactgcaccccctccatgccgctgtatgaccagtagctccccttaccaagagtttctatggagaatgcagcgtcccggaaatattgatgccccatcgtataggagtctttctaagggaacccccaccttcactgcccacacccatatgccccgcaactgctatcactctgccactctttgcatgcatgcaaatactcattattggacaggaaaaatgattaatcctagttgtcctggaggacttggagtcactgtctgttggacttacttcacccaaactggtatgtctgatgggggtggagttcaagatcaggcaagagaaaaacatgtaaaagaagtaatctcccaactcacccgggtacatggcacctctagcccctacaaaggactagatctctcaaaactacatgaaaccctccgtacccatactcgcctggtaagcctatttaataccaccctcactgggctccatgaggtctcggcccaaaaccctactaactgttggatatgcctccccctgaacttcaggccatatgtttcaatccctgtacctgaacaatggaacaacttcagcacagaaataaacaccacttccgttttagtaggacctcttgtttccaatctggaaataacccatacctcaaacctcacctgtgtaaaatttagcaatactacatacacaaccaactcccaatgcatcaggtgggtaactcctcccacacaaatagtctgcctaccctcaggaatattttttgtctgtggtacctcagcctatcgttgtttgaatggctcttcagaatctatgtgcttcctctcattcttagtgccccctatgaccatctacactgaacaagatttatacagttatgtcatatctaagccccgcaacaaaagagtacccattcttccttttgttataggagcaggagtgctaggtgcactaggtactggcattggcggtatcacaacctctactcagttctactacaaactatctcaagaactaaatggggacatggaacgggtcgccgactccctggtcaccttgcaagatcaacttaactccctagcagcagtagtccttcaaaatcgaagagctttagacttgctaaccgctgaaagagggggaacctgtttatttttaggggaagaatgctgttattatgttaatcaatccggaatcgtcactgagaaagttaaagaaattcgagatcgaatacaacgtagagcagaggagcttcgaaacactggaccctggggcctcctcagccaatggatgccctggattctccccttcttaggacctctagcagctataatattgctactcctctttggaccctgtatctttaacctccttgttaactttgtctcttccagaatcgaagctgtaaaactacaaatggagcccaagatgcagtccaagactaagatctaccgcagacccctggaccggcctgctagcccacgatctgatgttaatgacatcaaaggcacccctcctgaggaaatctcagctgcacaacctctactacgccccaattcagcaggaagcagttagagcggtcgtcggccaacctccccaacagcacttaggttttcctgttgagatgggggactgagagacaggactagctggatttcctaggctgactaagaatccctaagcctagctgggaaggtgaccacatccacctttaaacacggggcttgcaacttagctcacacctgaccaatcagagagctcactaaaatgctaattaggcaaagacaggaggtaaagaaatagccaatcatctattgcctgagagcacagcaggagggacaatgatcgggatataaacccaagtcttcgagccggcaacggcaaccccctttgggtcccctccctttgtatgggagctctgttttcatgctatttcactctattaaatcttgcaactgc

SEQ ID NO: 129689 - DNA, 2763 bp, Homo sapiens
  Payload ID: 5366
  Gene Symbol: ERVW-1
  Gene Name: endogenous retrovirus group W, member 1
  Uniprot ID: Q9UQF0
  ENST ID: ENST00000603053
  CDS Start-End: 762-2378
atgggagctgttttcatgctatttcactctattaaatcttgcaactgcactcttctggtccatgtttcttacggctcgagctgagcttttgctcaccgtccaccactgctgtttgccaccaccgcagacctgccgctgactcccatccctctggatcctgcagggtgtccgctgtgctcctgatccagcgaggcgcccattgccgctcccaattgggctaaaggcttgccattgttcctgcacggctaagtgcctgggtttgttctaattgagctgaacactagtcactgggttccatggttctcttctgtgacccacggcttctaatagaactataacacttaccacatggcccaagattccattccttggaatccgtgaggccaagaactccaggtcagagaatacgaggcttgccaccatcttggaagcggcctgctaccatcttggaagtggttcaccaccatcttgggagctctgtgagcaaggaccccccggtaacattttggcaaccacgaacggacatccaaagtgatacatcctgggaaggaccctacccagtcattttatctaccccaactgcggttaaagtggctggagtggagtcttggatacatcacacttgagtcaaatcctggatactgccaaaggaacctgaaaatccaggagacaacgctagctattcctgtgaacctctagaggatttgcgcctgctcttcaaacaacaaccaggaggaaagtaactaaaatcataaatccccatggccctcccttatcatatttttctctttactgttcttttaccctctttcactctcactgcaccccctccatgccgctgtatgaccagtagctccccttaccaagagtttctatggagaatgcagcgtcccggaaatattgatgccccatcgtataggagtctttctaagggaacccccaccttcactgcccacacccatatgccccgcaactgctatcactctgccactctttgcatgcatgcaaatactcattattggacaggaaaaatgattaatcctagttgtcctggaggacttggagtcactgtctgttggacttacttcacccaaactggtatgtctgatgggggtggagttcaagatcaggcaagagaaaaacatgtaaaagaagtaatctcccaactcacccgggtacatggcacctctagcccctacaaaggactagatctctcaaaactacatgaaaccctccgtacccatactcgcctggtaagcctatttaataccaccctcactgggctccatgaggtctcggcccaaaaccctactaactgttggatatgcctccccctgaacttcaggccatatgtttcaatccctgtacctgaacaatggaacaacttcagcacagaaataaacaccacttccgttttagtaggacctcttgtttccaatctggaaataacccatacctcaaacctcacctgtgtaaaatttagcaatactacatacacaaccaactcccaatgcatcaggtgggtaactcctcccacacaaatagtctgcctaccctcaggaatattttttgtctgtggtacctcagcctatcgttgtttgaatggctcttcagaatctatgtgcttcctctcattcttagtgccccctatgaccatctacactgaacaagatttatacagttatgtcatatctaagccccgcaacaaaagagtacccattcttccttttgttataggagcaggagtgctaggtgcactaggtactggcattggcggtatcacaacctctactcagttctactacaaactatctcaagaactaaatggggacatggaacgggtcgccgactccctggtcaccttgcaagatcaacttaactccctagcagcagtagtccttcaaaatcgaagagctttagacttgctaaccgctgaaagagggggaacctgtttatttttaggggaagaatgctgttattatgttaatcaatccggaatcgtcactgagaaagttaaagaaattcgagatcgaatacaacgtagagcagaggagcttcgaaacactggaccctggggcctcctcagccaatggatgccctggattctccccttcttaggacctctagcagctataatattgctactcctctttggaccctgtatctttaacctccttgttaactttgtctcttccagaatcgaagctgtaaaactacaaatggagcccaagatgcagtccaagactaagatctaccgcagacccctggaccggcctgctagcccacgatctgatgttaatgacatcaaaggcacccctcctgaggaaatctcagctgcacaacctctactacgccccaattcagcaggaagcagttagagcggtcgtcggccaacctccccaacagcacttaggttttcctgttgagatgggggactgagagacaggactagctggatttcctaggctgactaagaatccctaagcctagctgggaaggtgaccacatccacctttaaacacggggcttgcaacttagctcacacctgaccaatcagagagctcactaaaatgctaattaggcaaagacaggaggtaaagaaatagccaatcatctattgcctgagagcacagcaggagggacaatgatcgggatataaacccaagtcttcgagccggcaacggcaaccccctttgggtcccctccctttgtatgggagctctgttttcatgctatttcactctattaaatcttgcaactgca

SEQ ID NO: 129690 - DNA, 3059 bp, Homo sapiens
  Payload ID: 5367
  Gene Symbol: ENG
  Gene Name: endoglin
  Uniprot ID: P17813
  ENST ID: ENST00000344849
  CDS Start-End: 282-2159
cctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgtgagtaccccaggcccccacagtgagcatgccgggcccctccatccacccgggggagcccagtgaagcctctgagggattgaggggccctggccaggaccctgacctccgcccctgcccccgctcccgctcccaggttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacc

SEQ ID NO: 129691 - DNA, 3048 bp, Homo sapiens
  Payload ID: 5367
  Gene Symbol: ENG
  Gene Name: endoglin
  Uniprot ID: P17813
  ENST ID: ENST00000373203
  CDS Start-End: 402-2378
ggcaggcggcctggcccagccccttctctaaggaagcgcatttcctgcctccctgggccggccgggctggatgagccaggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaaccagtga

SEQ ID NO: 129692 - DNA, 2804 bp, Homo sapiens
  Payload ID: 5367
  Gene Symbol: ENG
  Gene Name: endoglin
  ENST ID: ENST00000480266
  CDS Start-End: 705-2135
aaggctgctgtgaggatcaaatgagttcactcgtgtaaagctgcctaggctcccagtaagcatgatgggagcatctgcagtgattattggtggtctgcaaatggggaaactgaggctcagagaggttaggcttctgctcaaggtgaccagcattttaagaggcagagctgggatttgatccaggccatctggctccagagctgtttttcttgatcatcctccaaggtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaaccagtg

SEQ ID NO: 129693 - DNA, 4037 bp, Homo sapiens
  Payload ID: 5368
  Gene Symbol: EMCN
  Gene Name: endomucin
  Uniprot ID: Q9ULC0
  ENST ID: ENST00000296420
  CDS Start-End: 180-965
gggagtgtgtgtatttcctcccgttctttatcagagcccccaaaataagtaggaatgggcagtggctattcacattcactacaccttttccatttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagactgaaactcagagttcaattaaaacaacagaaataccaggtagtgttctacaaccagatgcatcaccttctaaaactggtacattaacctcaataccagttacaattccagaaaacacctcacagtctcaagtaataggcactgagggtggaaaaaatgcaagcacttcagcaaccagccggtcttattccagtattattttgccggtggttattgctttgattgtaataacactttcagtatttgttctggtgggtttgtaccgaatgtgctggaaggcagatccgggcacaccagaaaatggaaatgatcaacctcagtctgataaagagagcgtgaagcttcttaccgttaagacaatttctcatgagtctggtgagcactctgcacaaggaaaaaccaagaactgacagcttgaggaattctctccacacctaggcaataattacgcttaatcttcagcttctatgcaccaagcgtggaaaaggagaaagtcctgcagaatcaatcccgacttccatacctgctgctggactgtaccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcagtgttcttatattacctactgttagtatttattgtttaccactatgttaatgcagggaaaagttgcacgtgtattattaaatattaggtagaaatcataccatgctactttgtacatataagtattttattcctgctttcgtgttacttttaataaataactactgtactcaatactctaaaaatactataacatgactgtgaaaatggcaatgttattgtcttcctataattatgaatatttttggatggattattagaatacatgaactcactaatgaaaggcatttgtaataagtcagaaagggacatacgattcacatatcagactgttagggggagagtaatttatcagttctttggtctttctatttgtcattcatactatgtgatgaagatgtaagtgcaagggcatttataacactatactgcattcattaagataataggatcatgatttttcattaactcatttgattgatattatctccatgcattttttatttcttttagaaatgtaattatttgctctagcaatcattgctaacctctagtttgtagaaaatcaacactttataaatacataattatgatattatttttcattgtatcactgttctaaaaataccatatgattatagctgccactccatcaggagcaaattcttctgttaaaagctaactgatcaaccttgaccacttttttgacatgtgagatcaaagtgtcaagttggctgaggttttttggaaagctttagaactaataagctgctggtggcagctttgtaacgtatgattatctaagctgattttgatgctaaattatcttagtgatctaaggggcagtttagtgaagatggaatcttgtatttaaaatagccttttaaaatttgttttgtggtgatgtattttgacaacttccatctttaggagttatataatcaccttgattttagtttcctgatgtttggactatttataatcaaggacaccaagcaagcataagcatatctatatttctgactggtgtctctttgagaaggatgggaagtagaaaaaaaaaaaagaaagaaaggaaaggaagagaggagagaagaaggcagggatctccactatgtatgttttcactttagaactgttgagcccatgcttaattttaatctagaagtctttaaatggtgagacagtgactggagcatgccaatcagagagcatttgtcttcagaaaaaaaaaaaatctgagtttgagactagcctggccaacatgttgaaaccccatatctactaaaaatacaaaaattagcctggtgtggtggcgcacgcctgtagtcccagctactctggagcctgaggaacgtgaatcgcttgaacccagaagacagaggttgcagtgagctgagatggcactattgcactccagcctgggtgacacagcaagactctgtctcaaaaaaaaaaaaaaaaaaaaggaaaaaaaagaaagaaagaaagtcccagcacacctagataatttaccgagctcttcagcaaaaaccatgttacatacagcatattccaaagaaatgaactcttctgcaatttaaattataagtaatatgttattttggatcctagagaaaccattttctctacatttcatgagcatggttagaaaagagtttacaagaattaggaagagggaacaattttaatggtcagaaaagaataaaatttattctagttcaagaagtgcacacaaagaatatgcattaatctaacaactatgagattaaatctttcaaaaaggtcaaaggaggattgagaagtttacagagatgtccacggcattttatatcaatctcaaaggtaaggtctgcatttttataaaccaacttaaacttctgttgagataggatattttgttttcaagccaaaattaccattaatcaaatatgttttaattatctgatttagatgatctactttttatgcctggcttactgtaagttttttattctgatacacagttcaaacatcattgcaacaaagaagtgcctgtatttagatcaaaggcaagactttctatgtgtttgttttgcataataatatgaatataatttaagtctatcaatagtcaaaacataaacaaaagctaattaactggcactgttgtcacctgagactaagtggatgttgttggctgacatacaggctcagccagcagagaaagaattctgaattccccttgctgaactgaactattctgttacatatggttgacaaatctgtgtgttatttcttttctacctaccatatttaaatttatgagtatcaaccgaggacatagtcaaaccttcgatgatgaacattcctgattttttgcctgattattctctgttgagctctacttgtggtcattcaagattttatgatgttgaaaggaaaagtgaatatgacctttaaaaattgtattttgggtgatgatagtctcaccactataaaactgtcaattattgcctaatgttaaagatatccatcattgtgattaattaaacctataatgagtattcttaatggagaattcttaatggatggattatcccctgatcttttctttaaaatttctctgcacacacaggacttctcattttccaataaatgggtgtactctgccccaatttctagggaa

SEQ ID NO: 129694 - DNA, 1575 bp, Homo sapiens
  Payload ID: 5368
  Gene Symbol: EMCN
  Gene Name: endomucin
  Uniprot ID: Q9ULC0
  ENST ID: ENST00000305864
  CDS Start-End: 90-626
catttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagactgaaactcagagttcaattaaaacaacagaaataccaggcacaccagaaaatggaaatgatcaacctcagtctgataaagagagcgtgaagcttcttaccgttaagacaatttctcatgagtctggtgagcactctgcacaaggaaaaaccaagaactgacagcttgaggaattctctccacacctaggcaataattacgcttaatcttcagcttctatgcaccaagcgtggaaaaggagaaagtcctgcagaatcaatcccgacttccatacctgctgctggactgtaccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcagtgttcttatattacctactgttagtatttattgtttaccactatgttaatgcagggaaaagttgcacgtgtattattaaatattaggtagaaatcataccatgctactttgtacatataagtattttattcctgctttcgtgttacttttaataaataactactgtactcaatactctaaaaatactataacatgactgtgaaaatggcaatgttattgtcttcctataattatgaatatttttggatggattattagaatacatgaactcactaatgaaaggcatttgtaataagtcagaaagggacatacgattcacatatcagactgttagggggagagtaatttatcagttctttggtctttctatttgtcattcatactatgtgatgaagatgtaagtgcaagggcatttataacactatactgcattcattaagataataggatcatgatttttcattaactcatttgattgatattatctccatgcattttttatttcttttagaaatgtaattatttgctctagcaatcattgct

SEQ ID NO: 129695 - DNA, 1377 bp, Homo sapiens
  Payload ID: 5368
  Gene Symbol: EMCN
  Gene Name: endomucin
  Uniprot ID: Q9ULC0
  ENST ID: ENST00000511970
  CDS Start-End: 88-834
tttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagagtagtgttctacaaccagatgcatcaccttctaaaactggtacattaacctcaataccagttacaattccagaaaacacctcacagtctcaagtaataggcactgagggtggaaaaaatgcaagcacttcagcaaccagccggtcttattccagtattattttgccggtggttattgctttgattgtaataacactttcagtatttgttctggtgggtttgtaccgaatgtgctggaaggcagatccgggcacaccagaaaatggaaatgatcaacctcagtctgataaagagagcgtgaagcttcttaccgttaagacaatttctcatgagtctggtgagcactctgcacaaggaaaaaccaagaactgacagcttgaggaattctctccacacctaggcaataattacgcttaatcttcagcttctatgcaccaagcgtggaaaaggagaaagtcctgcagaatcaatcccgacttccatacctgctgctggactgtaccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcagtgttcttatattacctactgttagtatttattgtttaccactatgttaatgcagggaaaagttgcacgtgtattattaaatattaggtagaaatcataccatgctactttgtacatataagtattttattcctgctt

SEQ ID NO: 129696 - DNA, 850 bp, Homo sapiens
  Payload ID: 5368
  Gene Symbol: EMCN
  Gene Name: endomucin
  ENST ID: ENST00000506300
  CDS Start-End: 1-231
ctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagactgaaactcagagttcaattaaaacaacagaaataccaggtgagcactctgcacaaggaaaaaccaagaactgacagcttgaggaattctctccacacctaggcaataattacgcttaatcttcagcttctatgcaccaagcgtggaaaaggagaaagtcctgcagaatcaatcccgacttccatacctgctgctggactgtaccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcagtgttcttatattacctactgttagtatttattgtttaccactatgttaatgcagggaaaagttgcacgtgtattattaaatattaggtagaaatcataccatgctactttgtacatataagtattttattcctgctttcgtgttacttttaataaataactactgtactcaatactctaaaaatactataacatgactgtgaaaatggcaatg

SEQ ID NO: 129697 - DNA, 583 bp, Homo sapiens
  Payload ID: 5368
  Gene Symbol: EMCN
  Gene Name: endomucin
  ENST ID: ENST00000502569
  CDS Start-End: 89-583
atttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagactgaaactcagagttcaattaaaacaacagaaataccaggtattattttgccggtggttattgctttgattgtaataacactttcagtatttgttctggtgggtttgtaccgaatgtgc

SEQ ID NO: 129698 - DNA, 4687 bp, Homo sapiens
  Payload ID: 5369
  Gene Symbol: ENDOD1
  Gene Name: endonuclease domain containing 1
  Uniprot ID: O94919
  ENST ID: ENST00000278505
  CDS Start-End: 119-1621
aggttgcgacttcccttccctaccctgctcggctgcgtagtgcgctccccgcccagcctgcagagctcgcgccgcggcagcccagccgctcggccccgccgcgctcgcagaggccgccatgggcaccgcgcgctggctcgcgctgggcagcctcttcgccctggctgggctgctggaaggccggctcgtgggcgaggaggaagccggctttggcgaatgtgacaagttcttctacgccgggaccccgcctgcggggctggcggccgattcccacgtgaagatctgtcagcgcgcggagggtgctgagcgcttcgccaccctctacagcacccgggaccgcatccccgtgtactccgcgttccgcgccccgcgccctgcgcccggcggcgccgagcagcgatggctggtggagccgcagatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtggtatgtgaatctccacagcctaatggaccgggctttgaccccacagtgtggcagtggggaagacctatatatcctcacaggcacagtgccctcagactacagagttaaagacaaagtggcagtccctgagtttgtttggctggcagcctgttgtgctgtccctggaggaggctgggccatgggctttgtcaagcacacccgggacagtgacatcatagaagatgtgatggtaaaagatcttcagaaactgcttccatttaaccctcagctgtttcagaacaactgtggtgaaactgagcaagacacagagaaaatgaaaaaaatcctggaagtggttaaccaaatccaggatgaagaacgaatggtacaatctcaaaagagttctagtcccctttctagcaccaggagcaagaggtctactctgttgcctccagaggcatctgagggaagtagtagctttttgggaaaactcatgggcttcattgctaccccattcatcaagctttttcaattaatttattaccttgtggtagcaatcctgaagaacattgtctatttcctgtggtgtgttaccaagcaggtgattaatggcatagaaagttgcctttaccgcctgggctcagccaccatctcatacttcatggccattggggaagagttggtgagcattccctggaaggtgctcaaggtcgtggccaaagtcatcagggctctcctccggatcctttgttgtctgctgaaggccatttgccgagttctgagcatccctgtccgtgtccttgtggatgtggccactttccctgtgtacaccatgggcgctattccaattgtttgcaaggacattgcactgggccttggtggcactgtctcactgctctttgacactgcttttggtaccctgggtggcctatttcaggtggtttttagtgtctgcaagcggattggctacaaggttacttttgacaattctggggagttataaactcaaaaaactaatagtatccagtcacagtgaatttgaaagctggaatagtttgtctttacaatgggtttctgttcactgtcagttatcattatattttggcctttggtggggatgtctgcttgtttttgcaaaagaagatggcagaatttagacttgacagaggagaaatgctcagggtgagattaggtgtagtaatctgctgtttacctccagttatatgtgcaaactcccaagccactaataacttcagttatgcactctaacacagacgaccacctgaaatgcactggtatttatttctgataattaaaaattacaggggagggaagaactagaaaaagaacaactttagaccaaaggtgtctgagaaaaggagaaagggagcttgttcttcccattgctctttgtgatttaaggcaaaacagattaaaaaaaaaatctgcagccaatttcttggcatttgcttctctttctcctcaactcgactgaccttggtggaatgcagataatgcctctttgttgaaataactttgtgggaatgtacaattttctatatctcttagctttccgtggttctcaaggatatgtacagttttcattttcctccaaagttgaattttgctacatttttcttttaggtaatgataagcattttttaaaaaatcatttttaggtaatggtaagcattttatgccaaatgtggcataacagagtttgaattgaagggcaaagttttcttttcttttttttttgggccccttgaatggtataatacagtcctctccggtggaaagaagagaagagaaggtggacagccctgctcttagtaggtgctgcagatccaaggacatcttttgtccagcttggattaacttgacgtgtatccctgcctgacaaggttgaactgaaagatctatatgttaagctaacatgaaaattcatattctgcaacatagtagatttttctaatgcatgaaataagtacccagcacagtaaaaatactctgacttatgtccctaaatggttgttttgatacaactatatagaaaagagccacaaaataaagataaaagttattgtggccatctctgaaaaaaatatataaaatatttaagaataattatatcttaggaaattatttttacagtgtgtttgaggctacaaacataactcccccattaatacaaattaaatgtgagagctcattctcaaaatttttttgatcaagcacttgtcattttaaatcttgcactaaaaaatggtaacaagagggaccaaactttgcttcccacaattgggatggaatcacctggatttttctgaatgttttaaagaattgctgagaggtagaaacagccaagtatgaaatactgatcttggggctaccgcccaggatcaatcagaaagttatatgcaaaaattcggggtcccaacaaggagagaacaatatgtcaaccatttgcatggggtcgatggatgagaaacatgagcgtagcaagagttacattttgcagaaaaatagcggaggcacacccagagtagaacagcagccagcaagctgccatcctgatcaatttgtgatgcaaggttagggagtatgagcaccgcatgggtccatgctagggagatgtgcaccaggcttagctaagaaacttaaagcagtattttaccaactcttgtcttagggagcataaagtttggatgtccctttatttcagcagtgtgaaggtaaatggaagggtgagggtttgacttggtactgattggtcaagaatcctgctggataaagaaaaggaattttagaagtgaccagagggacagtccagccaaactattatttgataaggaacccaaggccctgggaggcaacaggctagcccttagtttcatggctagctgagagcagattaggagccaacgttgtttgcacatgtcccatcacacctgagatgtcagacatgggaagttcgtgctattattcagttgcctctctggaccatggcaagatttcctcattcatcaaacagactccaggccctgacaaagcagttggatttggcatgtgtgatgaaaacaattagccatccatgtacaacattatgcttactgcatcccatggaaacttaattccctcctagcacatatttgcatactgaaaggtccgaaaagggcatccacggcagcttgagccccttagcaccatgtaaggagcacagcatccaaacggcttcttgagaaccattggggaatgtctttctttttcacatccaattgtttagtgtctatttattcttgggtggccagttttgaaacctaaaaagggacaataaagcaaaaagtatcagtaaggataggtggctgagacccactgccctgagctactagtgtggctgtgcctgtgggtctctagaaccatctgcattggacgtgaagccacagcaggtggctggactgctggcctgttcctaatgagctacgctgggctttgaggtagaggttggggtttatgaaccccaactctggcttaaagatcttgctgtggctctgttatgttctgaggccttgggattagcctcttcctcattatggagctgattttctagtctgtggatcagctatgcctttggacacttctcttttccattgtgccttttgaatgttgtcttctcactcagcatcagcacttcgatctaaatgcagactaggtagttgggaggaggaaccaaagtgaaccatccttcatttattcagtcattcgttcatctgtcaaacacgtatttggacatcaaggttgcagagatgaacaatgcatggatttcatctttgaggagttcaaaacctagtggagagaacacatggtacaatcgtaacacatgaaggacaagtaagtgctgcagtaaaggtactaataacatgttccttggaacagaggaagaaaaaccacgaaaccatggaaattagggaagcctttacagagggtgtgacaaaactcaatttgacattttcaagctatgtacaatgatgtgcaccttgcagatgctcaataaagtaattactgacaa

SEQ ID NO: 129699 - DNA, 1172 bp, Homo sapiens
  Payload ID: 5370
  Gene Symbol: ENDOG
  Gene Name: endonuclease G
  Uniprot ID: Q14249
  ENST ID: ENST00000372642
  CDS Start-End: 212-1105
aaatgcgcaaagaaaggacgccggggacacccggttgggctctgctgctcccttctgggttccgaggcccaagcccttggcagtgtttgtgagtggaagggaggtcacgctatcgtccgcggccccagcagccctgtgccctcgttggatcccgcgacgcggctcctttaagagcctcgcgggtcgcccgccgctaggtcgctccccggccatgcgggcgctgcgggccggcctgaccctggcgtcgggcgcggggctgggtgcggtcgtcgagggctggcggcggcggcgggaggacgcgcgggcggcgccgggactgctgggccggctgcccgtgctgcccgtggcggcggcagccgagttgccccctgtgcccgggggaccccgcggcccgggcgagctggccaagtacgggctgccggggctggcgcagctcaagagccgcgagtcgtacgtgctgtgctacgacccgcgcacccgcggcgcgctctgggtggtggagcagctgcgacccgagcgtctccgcggcgacggcgaccggcgcgagtgcgacttccgcgaggacgactcggtgcacgcgtaccaccgtgccaccaacgccgactaccgcggcagtggcttcgaccgcggtcacctggccgccgccgccaaccaccgctggagccagaaggccatggacgacacgttctacctgagcaacgtcgcgccccaggtgccccacctcaaccagaatgcctggaacaacctggagaaatatagccgcagcttgacccgcagctaccaaaacgtctatgtctgcacagggccactcttcctgcccaggacagaggctgatgggaaatcctacgtaaagtaccaggtcatcggcaagaaccacgtggcagtgcccacacacttcttcaaggtgctgatcctggaggcagcaggtgggcaaattgagctccgcacctacgtgatgcccaacgcacctgtggatgaggccatcccactggagcgcttcctggtgcccatcgagagcattgagcgggcttcggggctgctctttgtgccaaacatcctggcgcgggcaggcagcctcaaggccatcacggcgggcagtaagtgagggtggagcccagtgagactgtgggtgtgtgcaggccggggagtattaaaggtggtgatttttggag

SEQ ID NO: 129700 - DNA, 1226 bp, Homo sapiens
  Payload ID: 5371
  Gene Symbol: ENDOV
  Gene Name: endonuclease V
  Uniprot ID: Q8N8Q3
  ENST ID: ENST00000323854
  CDS Start-End: 12-806
gggacgaagccatggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcaggtgagggccagcccccacaggaccacagcccaggccccaggacagccccaaggccaggctcccaggagcaggcgggcaaggactggcagtagggtggaactgggcaccatgaagacaagaaggccaccggccaccccgttctggcctcaggacactgaccacccctgggggtggtctagggacttaggggaacctcatctcagccgcaggtggagcacccagtccccaaagacaggctgaccgcaccaccccagggggacgccgcagcacagcccagcaccaggtggggcagaggtgaccacggcccctctttgctccgtcatcggctggtcagctgtggtcacggtgcctcagaggacagatctctatgggggcaagtgccagatcctgagagcgcatgagacgctttcccggagccgacgaaggggactcggagctgcagcctgcacgacccctgcagcctgtgctttgcccacccctttcaatagatggaacttgcttgctctttttta

SEQ ID NO: 129701 - DNA, 864 bp, Homo sapiens
  Payload ID: 5371
  Gene Symbol: ENDOV
  Gene Name: endonuclease V
  ENST ID: ENST00000523999
  CDS Start-End: 18-335
gtgcccgggacgaagccatggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgagttctgccttcaggtagcaaaacagaacggatcttccctgccttctgcttgtcagcccttctgctgctggaaacagctgcctgctccttgaccacactgtcccaagaggctgcgatgacgtccagcttcttcactggttcagctgttgctgctctggaatattctctctcgcgcacatgcgctctttgtgtgcgtgtgtaccgtacatcccagcgactgtgacagctcagaagacatcagcaggcctgtcctgagaatgacattctcctccacagccacagtgtcattatcatactgattacacatcatagtcatcccataatgtcacctgaatgataacattatgggagagattcagatgtaagcagccacgcccctcctgtgggaactcaggccacacttgaattccacatgtcactgtgcaaagtgacttttactctgtggggatgtcagtgatccagcctgctggcttctctgtgaacccaaattctgttatcagaatggaccctccccactttgggtcatgggcagatttgatcagtttccccattgagtcattgatgaagatgttgtgagaatgatccccaaccctctgtgctaatacagagcactccgtctgc

SEQ ID NO: 129702 - DNA, 908 bp, Homo sapiens
  Payload ID: 5371
  Gene Symbol: ENDOV
  Gene Name: endonuclease V
  ENST ID: ENST00000517295
  CDS Start-End: 175-885
gcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtggtgtatgaggagagccgcatggtcagcctcacagccccctacgtgtcgggcttcctggccttccgagaggtgcccttcttgctggagctggtgcagcagctgcgggagaaggagccgggcctcatgccccaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatgcccacaggacagccctcgccttccttgtcacaggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcaggtggagcacccagtccccaaagacaggctgaccgcaccaccccagggggacgccgcagcacagcccagcaccaggtggggcagaggtgaccacggcccctctttgctccgtc

SEQ ID NO: 129703 - DNA, 617 bp, Homo sapiens
  Payload ID: 5371
  Gene Symbol: ENDOV
  Gene Name: endonuclease V
  ENST ID: ENST00000519117
  CDS Start-End: 18-311
gtgcccgggacgaagccatggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgagggatggccctgtcctgagggccgaggggcagctcagctgactgtgactctccctgtggctccataggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctg

SEQ ID NO: 129704 - DNA, 2815 bp, Homo sapiens
  Payload ID: 5371
  Gene Symbol: ENDOV
  Gene Name: endonuclease V
  Uniprot ID: Q8N8Q3
  ENST ID: ENST00000518137
  CDS Start-End: 29-877
gtgcggaaggggtgcccgggacgaagccatggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtggtgtatgaggagagccgcatggtcagcctcacagccccctacgtgtcgggcttcctggccttccgagaggtgcccttcttgctggagctggtgcagcagctgcgggagaaggagccgggcctcatgccccaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcagcactttgttgaacgtggtggtgagagcacacgtcctcgtctcattcctgatcgaacgcggtggtgagagcacacgtcctcgtctcgttcctgatcgaacgcggtggtgagagcacacatcctcgtctcgttcctgatcgaacgcggtggtgagagcacacgtcctcgtctcgttcctgatcgaacgtggtggtgagagcacacgtccttgtcttgttcctgatcttaagggaacgtttgcagtctttcaccactagatgtgatgtgagctgttagattttcaaggatgctcttcatccagctgaagacggtcccttctagtcctaatttgttaagtgtttttatccttaaagggtactggattttgtcaaatgcttttctggcctctattgaaaagatcctgtgttcttctgtgaatatgaggtgttacattgattgattttcatatgttgagccagtttccatttgtggaatacatctaactcggtcatggtgtataatccatttactctgctgctgaatgtgatttgcttgtattttggtgcggatttttacatctgtatttataagggatattggtctggtgttttcttatgatgtcttcctttggttttgatatcaggataatattagcctcatagattgggttaggaaatgttctctcctccgttttttttggaagagagagattggtgttaattcttgctagaacctttggtagaatttgccagtaagcctatctggtcttgggtctttgggaggattttgattcgattcaatctatgtatttgttatagatcgttcggattgtccatccttgagtcagttgctagcttgtgtgtttcttggagtttttccgtttcgtccatgttatctcatctgttggcataccgtcgttcacgggattttattgatgtgtgtgaggtctctgagaacgtccctgccttcactcctgcttttagtcactggcatcttcttttaacttgggccatctggccgtgcatggttttgggagagtcctccttgactctgcagatgctgagcagtgatctggctgggaaaggggaccaggagtgcagggcacctgctgaggactcacctaagcccaagagtcagagagtcggagctccaaccacatctgcctgcatgcctttcccaggctctccccaggcggacagccagcaccccctccccaaagaccgggcagttcctgaccagcaccccaccaagtcctcagtaaggcctgtctttgggggagcagggtttcaggaggacagtgggggtggtgtagaactcatggctggcggttccgggcctctcaggaagctttgccactgggcttggggttaagtgggtgtggggctccgaaccctaaatgggtgagagttgaaatgaaagcggcacctgtagtccgtttggggtgcaggtgtgtgccaggggtcttcagccccggctgatggccacatgaaccacatgaggagaggcagggcgtgtcagcagcaaacctaagtgtgtgctcatttctgtgggcccttactctgtgacactgcagctctccagagagacgctttgaaaacaaaacaggaaagaacacacggccccgcgtctgttgcctgagtcactgtattccttaaaaggtgaaggaccctggtccttggcttttcgtgcacatgagaaaatgttggccaaggttagcgattatgcttctgtaatctgtaaccagaagtgctcttatgcccaaaccttgatgtgattctgctgtaatgtaacttcggagccagctggatggatgtgactgtgcaggtcctgagccccggcccccgtaaccaagcagtgggccgagacactgagccgggcagtcaaacaggagctctctaaggctgctcccgggctgggacctgggtctaggattctcagtaagacctttgaataaaactaacttgaattctt

SEQ ID NO: 129705 - DNA, 702 bp, Homo sapiens
  Payload ID: 5371
  Gene Symbol: ENDOV
  Gene Name: endonuclease V
  ENST ID: ENST00000522577
  CDS Start-End: 29-445
gtgcggaaggggtgcccgggacgaagccatggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcaggtgagggccag

SEQ ID NO: 129706 - DNA, 545 bp, Homo sapiens
  Payload ID: 5371
  Gene Symbol: ENDOV
  Gene Name: endonuclease V
  ENST ID: ENST00000523228
  CDS Start-End: 395-545
agtttgtctggcctgcgcttgcgcgggtctccgccgcctgggctcctagggactgtggcctcggcgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgagttctgccttcaggtagcaaaacagaacggatcttccctgccttctgcttgtcagcccttctgctgctggaaacagctgcctgctccttgaccacactgtcccaagaggctgcgatgacgtccagcttcttcactggtggtgtatgaggagagccgcatggtcagcctcacagccccctacgtgtcgggcttcctggccttccgagaggtgcccttcttgctggagctggtgcagcagctgcgggagaaggagccgggcctcatgccccaggtccttcttgtggatggaaacggggtactccaccacc

SEQ ID NO: 129707 - DNA, 508 bp, Homo sapiens
  Payload ID: 5371
  Gene Symbol: ENDOV
  Gene Name: endonuclease V
  ENST ID: ENST00000520484
  CDS Start-End: 31-402
acgtgcggaaggggtgcccgggacgaagccatggccctggaggcggcgggagggccgccggaggaaacgctgtcactgtggaaacggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactcc

SEQ ID NO: 129708 - DNA, 607 bp, Homo sapiens
  Payload ID: 5371
  Gene Symbol: ENDOV
  Gene Name: endonuclease V
  ENST ID: ENST00000521634
  CDS Start-End: 1-395
gctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggctgacatctgctcccgagagcacatccgcaagtcgctgggactccccgggccacccacaccgaggagcccgaaggcgcagaggccagtggcatgccccaaaggagactccggagagtcctcaggtggagcacccagtccccaaagacaggctgaccgcaccaccccagggggacgccgcagcacagcccagcaccaggtggggcagaggtgaccacggcccctctttgctccgtcatcggctggtcagctgtggtcacggtgcctcagaggacagatctctatgggggcaagtgccagatcctgagagcgcatgagacgctttcccggagccgacgaaggggactcggagctgcagcctgcacgacccctgcagcctgtgctttgcccacccctttcaatagatggaacttgcttgctcttttt

SEQ ID NO: 129709 - DNA, 727 bp, Homo sapiens
  Payload ID: 5371
  Gene Symbol: ENDOV
  Gene Name: endonuclease V
  ENST ID: ENST00000519331
  CDS Start-End: 1-513
cacgaccgcagcaccaggcccctctacatctccgtgggccacaggatgagcctggaggccgctgtgcgcctgacttgctgctgctgcaggttccggatcccagagcccgtgcgccaggttcacctcctgctctgttccagaaggtcctgggagagcacagacggggttagtgttggtctgctctctccctggctccgcgccgggccgtcttggtggccccatggtcacaggcgctgcggcgctcctggttgccaggtccaggctctcctgccaggccaggctgggccgctccaggggaaggctgacatctgctcccgagagcacatccgcaagtcgctgggactccccgggccacccacaccgaggagcccgaaggcgcagaggccagtggcatgccccaaaggagactccggagagtcctcaggtggagcacccagtccccaaagacaggctgaccgcaccaccccagggggacgccgcagcacagcccagcaccaggtggggcagaggtgaccacggcccctctttgctccgtcatcggctggtcagctgtggtcacggtgcctcagaggacagatctctatgggggcaagtgccagatcctgagagcgcatgagacgctttcccggagccgacgaaggggactcggagctgcagcctgcacgacccctgcagcctgtgctttgcccacccctttcaatagatggaacttgcttgctctttttta

SEQ ID NO: 129710 - DNA, 2680 bp, Homo sapiens
  Payload ID: 5371
  Gene Symbol: ENDOV
  Gene Name: endonuclease V
  Uniprot ID: Q8N8Q3
  ENST ID: ENST00000520367
  CDS Start-End: 29-742
gtgcggaaggggtgcccgggacgaagccatggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcagcactttgttgaacgtggtggtgagagcacacgtcctcgtctcattcctgatcgaacgcggtggtgagagcacacgtcctcgtctcgttcctgatcgaacgcggtggtgagagcacacatcctcgtctcgttcctgatcgaacgcggtggtgagagcacacgtcctcgtctcgttcctgatcgaacgtggtggtgagagcacacgtccttgtcttgttcctgatcttaagggaacgtttgcagtctttcaccactagatgtgatgtgagctgttagattttcaaggatgctcttcatccagctgaagacggtcccttctagtcctaatttgttaagtgtttttatccttaaagggtactggattttgtcaaatgcttttctggcctctattgaaaagatcctgtgttcttctgtgaatatgaggtgttacattgattgattttcatatgttgagccagtttccatttgtggaatacatctaactcggtcatggtgtataatccatttactctgctgctgaatgtgatttgcttgtattttggtgcggatttttacatctgtatttataagggatattggtctggtgttttcttatgatgtcttcctttggttttgatatcaggataatattagcctcatagattgggttaggaaatgttctctcctccgttttttttggaagagagagattggtgttaattcttgctagaacctttggtagaatttgccagtaagcctatctggtcttgggtctttgggaggattttgattcgattcaatctatgtatttgttatagatcgttcggattgtccatccttgagtcagttgctagcttgtgtgtttcttggagtttttccgtttcgtccatgttatctcatctgttggcataccgtcgttcacgggattttattgatgtgtgtgaggtctctgagaacgtccctgccttcactcctgcttttagtcactggcatcttcttttaacttgggccatctggccgtgcatggttttgggagagtcctccttgactctgcagatgctgagcagtgatctggctgggaaaggggaccaggagtgcagggcacctgctgaggactcacctaagcccaagagtcagagagtcggagctccaaccacatctgcctgcatgcctttcccaggctctccccaggcggacagccagcaccccctccccaaagaccgggcagttcctgaccagcaccccaccaagtcctcagtaaggcctgtctttgggggagcagggtttcaggaggacagtgggggtggtgtagaactcatggctggcggttccgggcctctcaggaagctttgccactgggcttggggttaagtgggtgtggggctccgaaccctaaatgggtgagagttgaaatgaaagcggcacctgtagtccgtttggggtgcaggtgtgtgccaggggtcttcagccccggctgatggccacatgaaccacatgaggagaggcagggcgtgtcagcagcaaacctaagtgtgtgctcatttctgtgggcccttactctgtgacactgcagctctccagagagacgctttgaaaacaaaacaggaaagaacacacggccccgcgtctgttgcctgagtcactgtattccttaaaaggtgaaggaccctggtccttggcttttcgtgcacatgagaaaatgttggccaaggttagcgattatgcttctgtaatctgtaaccagaagtgctcttatgcccaaaccttgatgtgattctgctgtaatgtaacttcggagccagctggatggatgtgactgtgcaggtcctgagccccggcccccgtaaccaagcagtgggccgagacactgagccgggcagtcaaacaggagctctctaaggctgctcccgggctgggacctgggtctaggattctcagtaagacctttgaataaaactaacttgaattctt

SEQ ID NO: 129711 - DNA, 1475 bp, Homo sapiens
  Payload ID: 5371
  Gene Symbol: ENDOV
  Gene Name: endonuclease V
  ENST ID: ENST00000522751
  CDS Start-End: 727-1074
cgagctcatagtcttcaggctgtggaatcggagctgccaccgcccgagactccaaagcaaagcccagtttccggcgcggaagcggagggatctcaggaattgtagtccgcggggtgggcgcggttctcgcttccggccagtttgtctggcctgcgcttgcgcgggtctccgccgcctgggctcctagggactgtggcctcggcggtatgtcccttgctttcccttgaagcgggagaagacccggcagaggcgctctgtccgctgcagccgcgcgggtggaggaggcagagtctgaggtgtgaccccgaccaagtttgacgcttctgtcctcctagggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcaggtgagggccagcccccacaggaccacagcccaggccccaggacagccccaaggccaggctcccaggagcaggcgggcaaggactggcagtagggtggaactgggcaccatgaagacaagaaggccaccggccaccccgttctggcctcaggacactgaccacccctgggggtggtctagggacttaggggaacctcatctcagccgcaggtggagcacccagtccccaaagacaggctgaccgcaccaccccagggggacgccgcagcacagcccagcaccaggtggggcagaggtgaccacggcccctctttgctccgtcatcggctggtcagctgtggtcacggtgcctcagaggacagatctctatgggggcaagtgccagatcctgagagcgcatgagacgctttcccggagccgacgaaggggactcggagctgcagcctgcacgacccctgcagcctgtgctttgcccacccctttcaatagatgga

SEQ ID NO: 129712 - DNA, 2418 bp, Homo sapiens
  Payload ID: 5371
  Gene Symbol: ENDOV
  Gene Name: endonuclease V
  Uniprot ID: Q8N8Q3
  ENST ID: ENST00000518907
  CDS Start-End: 333-530
gtctggcctgcgcttgcgcgggtctccgccgcctgggctcctagggactgtggcctcggcggtatgtcccttgctttcccttgaagcgggagaagacccggcagaggcgctctgtccgctgcagccgcgcgggtggaggaggcagagtctgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccagcactttgttgaacgtggtggtgagagcacacgtcctcgtctcattcctgatcgaacgcggtggtgagagcacacgtcctcgtctcgttcctgatcgaacgcggtggtgagagcacacatcctcgtctcgttcctgatcgaacgcggtggtgagagcacacgtcctcgtctcgttcctgatcgaacgtggtggtgagagcacacgtccttgtcttgttcctgatcttaagggaacgtttgcagtctttcaccactagatgtgatgtgagctgttagattttcaaggatgctcttcatccagctgaagacggtcccttctagtcctaatttgttaagtgtttttatccttaaagggtactggattttgtcaaatgcttttctggcctctattgaaaagatcctgtgttcttctgtgaatatgaggtgttacattgattgattttcatatgttgagccagtttccatttgtggaatacatctaactcggtcatggtgtataatccatttactctgctgctgaatgtgatttgcttgtattttggtgcggatttttacatctgtatttataagggatattggtctggtgttttcttatgatgtcttcctttggttttgatatcaggataatattagcctcatagattgggttaggaaatgttctctcctccgttttttttggaagagagagattggtgttaattcttgctagaacctttggtagaatttgccagtaagcctatctggtcttgggtctttgggaggattttgattcgattcaatctatgtatttgttatagatcgttcggattgtccatccttgagtcagttgctagcttgtgtgtttcttggagtttttccgtttcgtccatgttatctcatctgttggcataccgtcgttcacgggattttattgatgtgtgtgaggtctctgagaacgtccctgccttcactcctgcttttagtcactggcatcttcttttaacttgggccatctggccgtgcatggttttgggagagtcctccttgactctgcagatgctgagcagtgatctggctgggaaaggggaccaggagtgcagggcacctgctgaggactcacctaagcccaagagtcagagagtcggagctccaaccacatctgcctgcatgcctttcccaggctctccccaggcggacagccagcaccccctccccaaagaccgggcagttcctgaccagcaccccaccaagtcctcagtaaggcctgtctttgggggagcagggtttcaggaggacagtgggggtggtgtagaactcatggctggcggttccgggcctctcaggaagctttgccactgggcttggggttaagtgggtgtggggctccgaaccctaaatgggtgagagttgaaatgaaagcggcacctgtagtccgtttggggtgcaggtgtgtgccaggggtcttcagccccggctgatggccacatgaaccacatgaggagaggcagggcgtgtcagcagcaaacctaagtgtgtgctcatttctgtgggcccttactctgtgacactgcagctctccagagagacgctttgaaaacaaaacaggaaagaacacacggccccgcgtctgttgcctgagtcactgtattccttaaaaggtgaaggaccctggtccttggcttttcgtgcacatgagaaaatgttggccaaggttagcgattatgcttctgtaatctgtaaccagaagtgctcttatgcccaaaccttgatgtgattctgctgtaatgtaacttcggagccagctggatggatgtgactgtgcaggtcctgagccccggcccccgtaaccaagcagtgggccgagacactgagccgggcagtcaaacaggagctctctaaggctgctcccgggctgggacctgggtctaggattctcagtaagacctttgaataaaactaacttgaattcttcaaaa

SEQ ID NO: 129713 - DNA, 2500 bp, Homo sapiens
  Payload ID: 5371
  Gene Symbol: ENDOV
  Gene Name: endonuclease V
  Uniprot ID: Q8N8Q3
  ENST ID: ENST00000520284
  CDS Start-End: 419-616
cagtttgtctggcctgcgcttgcgcgggtctccgccgcctgggctcctagggactgtggcctcggcgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccagcactttgttgaacgtggtggtgagagcacacgtcctcgtctcattcctgatcgaacgcggtggtgagagcacacgtcctcgtctcgttcctgatcgaacgcggtggtgagagcacacatcctcgtctcgttcctgatcgaacgcggtggtgagagcacacgtcctcgtctcgttcctgatcgaacgtggtggtgagagcacacgtccttgtcttgttcctgatcttaagggaacgtttgcagtctttcaccactagatgtgatgtgagctgttagattttcaaggatgctcttcatccagctgaagacggtcccttctagtcctaatttgttaagtgtttttatccttaaagggtactggattttgtcaaatgcttttctggcctctattgaaaagatcctgtgttcttctgtgaatatgaggtgttacattgattgattttcatatgttgagccagtttccatttgtggaatacatctaactcggtcatggtgtataatccatttactctgctgctgaatgtgatttgcttgtattttggtgcggatttttacatctgtatttataagggatattggtctggtgttttcttatgatgtcttcctttggttttgatatcaggataatattagcctcatagattgggttaggaaatgttctctcctccgttttttttggaagagagagattggtgttaattcttgctagaacctttggtagaatttgccagtaagcctatctggtcttgggtctttgggaggattttgattcgattcaatctatgtatttgttatagatcgttcggattgtccatccttgagtcagttgctagcttgtgtgtttcttggagtttttccgtttcgtccatgttatctcatctgttggcataccgtcgttcacgggattttattgatgtgtgtgaggtctctgagaacgtccctgccttcactcctgcttttagtcactggcatcttcttttaacttgggccatctggccgtgcatggttttgggagagtcctccttgactctgcagatgctgagcagtgatctggctgggaaaggggaccaggagtgcagggcacctgctgaggactcacctaagcccaagagtcagagagtcggagctccaaccacatctgcctgcatgcctttcccaggctctccccaggcggacagccagcaccccctccccaaagaccgggcagttcctgaccagcaccccaccaagtcctcagtaaggcctgtctttgggggagcagggtttcaggaggacagtgggggtggtgtagaactcatggctggcggttccgggcctctcaggaagctttgccactgggcttggggttaagtgggtgtggggctccgaaccctaaatgggtgagagttgaaatgaaagcggcacctgtagtccgtttggggtgcaggtgtgtgccaggggtcttcagccccggctgatggccacatgaaccacatgaggagaggcagggcgtgtcagcagcaaacctaagtgtgtgctcatttctgtgggcccttactctgtgacactgcagctctccagagagacgctttgaaaacaaaacaggaaagaacacacggccccgcgtctgttgcctgagtcactgtattccttaaaaggtgaaggaccctggtccttggcttttcgtgcacatgagaaaatgttggccaaggttagcgattatgcttctgtaatctgtaaccagaagtgctcttatgcccaaaccttgatgtgattctgctgtaatgtaacttcggagccagctggatggatgtgactgtgcaggtcctgagccccggcccccgtaaccaagcagtgggccgagacactgagccgggcagtcaaacaggagctctctaaggctgctcccgggctgggacctgggtctaggattctcagtaagacctttgaataaaactaacttgaattcttc

SEQ ID NO: 129714 - DNA, 547 bp, Homo sapiens
  Payload ID: 5371
  Gene Symbol: ENDOV
  Gene Name: endonuclease V
  ENST ID: ENST00000521565
  CDS Start-End: 255-547
gtctggcctgcgcttgcgcgggtctccgccgcctgggctcctagggactgtggcctcggcgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtggtgtatgaggagagccgcatggtcagcctcacagccccctacgtgtcgggcttcctggccttccgagaggtgcccttcttgctggagctggtgcagcagctgcgggagaaggagccgggcctcatgccccaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggaga

SEQ ID NO: 129715 - DNA, 607 bp, Homo sapiens
  Payload ID: 5371
  Gene Symbol: ENDOV
  Gene Name: endonuclease V
  ENST ID: ENST00000523828
  CDS Start-End: 583-607
agtttgtctggcctgcgcttgcgcgggtctccgccgcctgggctcctagggactgtggcctcggcgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgagaaaccatgttgctttgcccaccatggatagcatgaggaagacgctggactcttccttcaagagatacgtgtgtgaatggacagtgggctcatgattcacataagagtcaacagctccggaagcctcttggcgtcactcgcattgctcctctgctgactcccgaaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgca

SEQ ID NO: 129716 - DNA, 2549 bp, Homo sapiens
  Payload ID: 5371
  Gene Symbol: ENDOV
  Gene Name: endonuclease V
  Uniprot ID: Q8N8Q3
  ENST ID: ENST00000518901
  CDS Start-End: 344-610
cgcctgggctcctagggactgtggcctcggcggtatgtcccttgctttcccttgaagcgggagaagacccggcagaggcgctctgtccgctgcagccgcgcgggtggaggaggcagagtctgaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcagcactttgttgaacgtggtggtgagagcacacgtcctcgtctcattcctgatcgaacgcggtggtgagagcacacgtcctcgtctcgttcctgatcgaacgcggtggtgagagcacacatcctcgtctcgttcctgatcgaacgcggtggtgagagcacacgtcctcgtctcgttcctgatcgaacgtggtggtgagagcacacgtccttgtcttgttcctgatcttaagggaacgtttgcagtctttcaccactagatgtgatgtgagctgttagattttcaaggatgctcttcatccagctgaagacggtcccttctagtcctaatttgttaagtgtttttatccttaaagggtactggattttgtcaaatgcttttctggcctctattgaaaagatcctgtgttcttctgtgaatatgaggtgttacattgattgattttcatatgttgagccagtttccatttgtggaatacatctaactcggtcatggtgtataatccatttactctgctgctgaatgtgatttgcttgtattttggtgcggatttttacatctgtatttataagggatattggtctggtgttttcttatgatgtcttcctttggttttgatatcaggataatattagcctcatagattgggttaggaaatgttctctcctccgttttttttggaagagagagattggtgttaattcttgctagaacctttggtagaatttgccagtaagcctatctggtcttgggtctttgggaggattttgattcgattcaatctatgtatttgttatagatcgttcggattgtccatccttgagtcagttgctagcttgtgtgtttcttggagtttttccgtttcgtccatgttatctcatctgttggcataccgtcgttcacgggattttattgatgtgtgtgaggtctctgagaacgtccctgccttcactcctgcttttagtcactggcatcttcttttaacttgggccatctggccgtgcatggttttgggagagtcctccttgactctgcagatgctgagcagtgatctggctgggaaaggggaccaggagtgcagggcacctgctgaggactcacctaagcccaagagtcagagagtcggagctccaaccacatctgcctgcatgcctttcccaggctctccccaggcggacagccagcaccccctccccaaagaccgggcagttcctgaccagcaccccaccaagtcctcagtaaggcctgtctttgggggagcagggtttcaggaggacagtgggggtggtgtagaactcatggctggcggttccgggcctctcaggaagctttgccactgggcttggggttaagtgggtgtggggctccgaaccctaaatgggtgagagttgaaatgaaagcggcacctgtagtccgtttggggtgcaggtgtgtgccaggggtcttcagccccggctgatggccacatgaaccacatgaggagaggcagggcgtgtcagcagcaaacctaagtgtgtgctcatttctgtgggcccttactctgtgacactgcagctctccagagagacgctttgaaaacaaaacaggaaagaacacacggccccgcgtctgttgcctgagtcactgtattccttaaaaggtgaaggaccctggtccttggcttttcgtgcacatgagaaaatgttggccaaggttagcgattatgcttctgtaatctgtaaccagaagtgctcttatgcccaaaccttgatgtgattctgctgtaatgtaacttcggagccagctggatggatgtgactgtgcaggtcctgagccccggcccccgtaaccaagcagtgggccgagacactgagccgggcagtcaaacaggagctctctaaggctgctcccgggctgggacctgggtctaggattctcagtaagacctttgaataaaactaacttgaattcttc

SEQ ID NO: 129717 - DNA, 625 bp, Homo sapiens
  Payload ID: 5371
  Gene Symbol: ENDOV
  Gene Name: endonuclease V
  ENST ID: ENST00000518644
  CDS Start-End: 244-561
gcttgcgcgggtctccgccgcctgggctcctagggactgtggcctcggcgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtggtgtatgaggagagccgcatggtcagcctcacagccccctacgtgtcgggcttcctggccttccgagaggtgcccttcttgctggagctggtgcagcagctgcgggagaaggagccgggcctcatgccccaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagctctcaggtgcctgcatggagaagttgcttaataaaaatctgttgagttgatggggaccttagacccactcaatgagccagtccaccgccgccagaaataccagcctgttgagct

SEQ ID NO: 129718 - DNA, 468 bp, Homo sapiens
  Payload ID: 5371
  Gene Symbol: ENDOV
  Gene Name: endonuclease V
  ENST ID: ENST00000520136
  CDS Start-End: 459-468
cagtttgtctggcctgcgcttgcgcgggtctccgccgcctgggctcctagggactgtggcctcggcgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctga

SEQ ID NO: 129719 - DNA, 334 bp, Homo sapiens
  Payload ID: 5371
  Gene Symbol: ENDOV
  Gene Name: endonuclease V
  ENST ID: ENST00000572886
  CDS Start-End: 1-329
gtgttggggtggccaagaaacttctgcaggtggatgggctggagaacaacgccctgcacaaggagaaggtaccacagcctccaggcccccctcccgccaagacctgcctggagctgccacccacactcttcctacctcaccttcccctgcatcttcctcctctgggaccccatgttggcactgggagtgagacactcacaatggagggagctgttgacacccccagctgtttcactggatggcagattctgagagcagagactgtgtctctcattcctcctagctctcaggtgcctgcatggagaagttgcttaataaaaatctgttgagttga

SEQ ID NO: 129720 - DNA, 855 bp, Homo sapiens
  Payload ID: 5371
  Gene Symbol: ENDOV
  Gene Name: endonuclease V
  ENST ID: ENST00000522200
  CDS Start-End: 391-855
agtttgtctggcctgcgcttgcgcgggtctccgccgcctgggctcctagggactgtggcctcggcggtatgtcccttgctttcccttgaagcgggagaagacccggcagaggcgctctgtccgctgcagccgcgcgggtggaggaggcagagtctgaggtgtgaccccgaccaagtttgacgcttctgtcctcctagggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtggtgtatgaggagagccgcatggtcagcctcacagccccctacgtgtcgggcttcctggccttccgagaggtgcccttcttgctggagctggtgcagcagctgcgggagaaggagccgggcctcatgccccaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccag

SEQ ID NO: 129721 - DNA, 2548 bp, Homo sapiens
  Payload ID: 5371
  Gene Symbol: ENDOV
  Gene Name: endonuclease V
  Uniprot ID: Q8N8Q3
  ENST ID: ENST00000517795
  CDS Start-End: 339-605
cagtttgtctggcctgcgcttgcgcgggtctccgccgcctgggctcctagggactgtggcctcggcggtatgtcccttgctttcccttgaagcgggagaagacccggcagaggcgctctgtccgctgcagccgcgcgggtggaggaggcagagtctgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcagcactttgttgaacgtggtggtgagagcacacgtcctcgtctcattcctgatcgaacgcggtggtgagagcacacgtcctcgtctcgttcctgatcgaacgcggtggtgagagcacacatcctcgtctcgttcctgatcgaacgcggtggtgagagcacacgtcctcgtctcgttcctgatcgaacgtggtggtgagagcacacgtccttgtcttgttcctgatcttaagggaacgtttgcagtctttcaccactagatgtgatgtgagctgttagattttcaaggatgctcttcatccagctgaagacggtcccttctagtcctaatttgttaagtgtttttatccttaaagggtactggattttgtcaaatgcttttctggcctctattgaaaagatcctgtgttcttctgtgaatatgaggtgttacattgattgattttcatatgttgagccagtttccatttgtggaatacatctaactcggtcatggtgtataatccatttactctgctgctgaatgtgatttgcttgtattttggtgcggatttttacatctgtatttataagggatattggtctggtgttttcttatgatgtcttcctttggttttgatatcaggataatattagcctcatagattgggttaggaaatgttctctcctccgttttttttggaagagagagattggtgttaattcttgctagaacctttggtagaatttgccagtaagcctatctggtcttgggtctttgggaggattttgattcgattcaatctatgtatttgttatagatcgttcggattgtccatccttgagtcagttgctagcttgtgtgtttcttggagtttttccgtttcgtccatgttatctcatctgttggcataccgtcgttcacgggattttattgatgtgtgtgaggtctctgagaacgtccctgccttcactcctgcttttagtcactggcatcttcttttaacttgggccatctggccgtgcatggttttgggagagtcctccttgactctgcagatgctgagcagtgatctggctgggaaaggggaccaggagtgcagggcacctgctgaggactcacctaagcccaagagtcagagagtcggagctccaaccacatctgcctgcatgcctttcccaggctctccccaggcggacagccagcaccccctccccaaagaccgggcagttcctgaccagcaccccaccaagtcctcagtaaggcctgtctttgggggagcagggtttcaggaggacagtgggggtggtgtagaactcatggctggcggttccgggcctctcaggaagctttgccactgggcttggggttaagtgggtgtggggctccgaaccctaaatgggtgagagttgaaatgaaagcggcacctgtagtccgtttggggtgcaggtgtgtgccaggggtcttcagccccggctgatggccacatgaaccacatgaggagaggcagggcgtgtcagcagcaaacctaagtgtgtgctcatttctgtgggcccttactctgtgacactgcagctctccagagagacgctttgaaaacaaaacaggaaagaacacacggccccgcgtctgttgcctgagtcactgtattccttaaaaggtgaaggaccctggtccttggcttttcgtgcacatgagaaaatgttggccaaggttagcgattatgcttctgtaatctgtaaccagaagtgctcttatgcccaaaccttgatgtgattctgctgtaatgtaacttcggagccagctggatggatgtgactgtgcaggtcctgagccccggcccccgtaaccaagcagtgggccgagacactgagccgggcagtcaaacaggagctctctaaggctgctcccgggctgggacctgggtctaggattctcagtaagacctttgaataaaactaacttgaattcttcaaaa

SEQ ID NO: 129722 - DNA, 2332 bp, Homo sapiens
  Payload ID: 5372
  Gene Symbol: ENDOU
  Gene Name: endonuclease, polyU-specific
  Uniprot ID: P21128
  ENST ID: ENST00000229003
  CDS Start-End: 155-1264
cttcctgaaaggatctggagacaccagctccacaagtcctggtgtctttaaaaggatcagcttgaggaataaggctcgtctgagagctgtgacattcatctgactctagtgaaagtccaacagccactccctttttggcctccaactgggcaccatgagggcctgcatctccctggtattggccgtgctgtgtggcctggcctgggctgaggaccacaaagagtcagagccattgccacagctggaggaagagacagaagaggccctcgccagcaacttgtactcggcacccacctcctgccagggccgctgctacgaagcctttgacaagcaccaccaatgtcactgcaatgcccgctgccaagagtttgggaactgctgcaaggattttgagagcctgtgtagtgaccacgaggtctcccacagcagtgatgccataacaaaagaggagattcagagcatctctgagaagatctacagggcagacaccaacaaagcccagaaggaagacatcgttctcaatagccaaaactgcatctccccgtcagagaccagaaaccaagtggatcgctgcccaaagccactcttcacttatgtcaatgagaagctgttctccaagcccacctatgcagccttcatcaacctcctcaacaactaccagcgggcaacaggccatggggagcacttcagtgcccaggagctggccgagcaggacgccttcctcagagagatcatgaagacagcagtcatgaaggagctctacagcttcctccatcaccagaatcgctatggctcagagcaagagtttgtcgatgacttgaagaacatgtggtttgggctctattcaagaggcaatgaagagggggactcgagtggctttgaacatgtcttctcaggtgaggtaaaaaaaggcaaggttactggcttccataactggatccgcttctacctggaggagaaggagggtctggttgactattacagtcacatctacgatgggccttgggattcttaccccgatgtgctggcaatgcagttcaactgggacggctactataaggaagtgggctctgctttcatcggcagcagccctgagtttgagtttgcactctactccctgtgcttcatcgccaggccaggcaaagtgtgccagttaagcctgggaggatatcccttagctgtccggacatatacctgggacaagtccacctatgggaatggcaagaagtacatcgccacagcctacatagtgtcttccacctaatagaacttcgagccagaaaggggcatgagggctcttgcgagactgaagtgctatcttctctggactagagagaagagggagaggactggaagggatcaccaaatctcaaagcaatgagaagcattcctaaatcccaaagtgcccacatgggaaagagataaaatgtacaaattagaaaaatgtggataaacagtcaaacctttatcctctagaattttggcaatgttgactaagaaacagagtccaagcagagaaggtaggaaccctccatagctctctgccctgatgtgtgggggaactaggaagaagtcctttgacctcaccaggcctcatgcttccctttaatgtaaagggaaggggtttgcccactttcctctttttggggttggtgagagggcaaaccctgatatttttactgtgaaggtgttttcagttgttcttaggaagaacagctgatagaaattcaagattactataatggctgttattatacacagctctgtaaactaccactcagccctgtgttggggtcctcaaagaagtaaggccacagtaatcaagcaagggcctttggttttttccagagttagatcctctcagaacagagtctgggagaactccaatgctgaatggagaagggtaataggttggtgcagtgaatgggctgggggtggggtggccttctccaggcctgagtgtttttgtgtccagctcagtatctgcaacaagaagtttcccacttgtggatgtttagtgcagccacagacttgtattttgatccccaatttttttttgaaagagttctcctcataggaggatgattcagcatcagaagaagaaggaacccatagcttggtgtcattaacataattattttaagccttatccagcagccataatttgaataactctacgagaccagagagactgtagttccctattttaacctcaattatgcatttgtcccccaaccccactgagaactaaatgctgtaccacagagccgggtgtgaactatggtttagaaggttcaagtttccaattaaagtcattgaagaaaacttgaaa

SEQ ID NO: 129723 - DNA, 2413 bp, Homo sapiens
  Payload ID: 5372
  Gene Symbol: ENDOU
  Gene Name: endonuclease, polyU-specific
  Uniprot ID: P21128
  ENST ID: ENST00000422538
  CDS Start-End: 124-1356
acaagtcctggtgtctttaaaaggatcagcttgaggaataaggctcgtctgagagctgtgacattcatctgactctagtgaaagtccaacagccactccctttttggcctccaactgggcaccatgagggcctgcatctccctggtattggccgtgctgtgtggcctggcctgggctggaaaaatagaatcctgtgcatctcgatgtaatgagaaatttaaccgggacgctgcctgccagtgtgaccgccggtgtctctggcatgggaactgctgtgaagactatgaacatctgtgtactgaggaccacaaagagtcagagccattgccacagctggaggaagagacagaagaggccctcgccagcaacttgtactcggcacccacctcctgccagggccgctgctacgaagcctttgacaagcaccaccaatgtcactgcaatgcccgctgccaagagtttgggaactgctgcaaggattttgagagcctgtgtagtgaccacgaggtctcccacagcagtgatgccataacaaaagaggagattcagagcatctctgagaagatctacagggcagacaccaacaaagcccagaaggaagacatcgttctcaatagccaaaactgcatctccccgtcagagaccagaaaccaagtggatcgctgcccaaagccactcttcacttatgtcaatgagaagctgttctccaagcccacctatgcagccttcatcaacctcctcaacaactaccagcgggcaacaggccatggggagcacttcagtgcccaggagctggccgagcaggacgccttcctcagagagatcatgaagacagcagtcatgaaggagctctacagcttcctccatcaccagaatcgctatggctcagagcaagagtttgtcgatgacttgaagaacatgtggtttgggctctattcaagaggcaatgaagagggggactcgagtggctttgaacatgtcttctcaggtgaggtaaaaaaaggcaaggttactggcttccataactggatccgcttctacctggaggagaaggagggtctggttgactattacagtcacatctacgatgggccttgggattcttaccccgatgtgctggcaatgcagttcaactgggacggctactataaggaagtgggctctgctttcatcggcagcagccctgagtttgagtttgcactctactccctgtgcttcatcgccaggccaggcaaagtgtgccagttaagcctgggaggatatcccttagctgtccggacatatacctgggacaagtccacctatgggaatggcaagaagtacatcgccacagcctacatagtgtcttccacctaatagaacttcgagccagaaaggggcatgagggctcttgcgagactgaagtgctatcttctctggactagagagaagagggagaggactggaagggatcaccaaatctcaaagcaatgagaagcattcctaaatcccaaagtgcccacatgggaaagagataaaatgtacaaattagaaaaatgtggataaacagtcaaacctttatcctctagaattttggcaatgttgactaagaaacagagtccaagcagagaaggtaggaaccctccatagctctctgccctgatgtgtgggggaactaggaagaagtcctttgacctcaccaggcctcatgcttccctttaatgtaaagggaaggggtttgcccactttcctctttttggggttggtgagagggcaaaccctgatatttttactgtgaaggtgttttcagttgttcttaggaagaacagctgatagaaattcaagattactataatggctgttattatacacagctctgtaaactaccactcagccctgtgttggggtcctcaaagaagtaaggccacagtaatcaagcaagggcctttggttttttccagagttagatcctctcagaacagagtctgggagaactccaatgctgaatggagaagggtaataggttggtgcagtgaatgggctgggggtggggtggccttctccaggcctgagtgtttttgtgtccagctcagtatctgcaacaagaagtttcccacttgtggatgtttagtgcagccacagacttgtattttgatccccaatttttttttgaaagagttctcctcataggaggatgattcagcatcagaagaagaaggaacccatagcttggtgtcattaacataattattttaagccttatccagcagccataatttgaataactctacgagaccagagagactgtagttccctattttaacctcaattatgcatttgtcccccaaccccactgagaactaaatgctgtaccacagagccgggtgtgaactatggtttagaaggttcaagtttccaattaaagtcattgaag

SEQ ID NO: 129724 - DNA, 1513 bp, Homo sapiens
  Payload ID: 5372
  Gene Symbol: ENDOU
  Gene Name: endonuclease, polyU-specific
  Uniprot ID: P21128
  ENST ID: ENST00000545824
  CDS Start-End: 122-1165
aagtcctggtgtctttaaaaggatcagcttgaggaataaggctcgtctgagagctgtgacattcatctgactctagtgaaagtccaacagccactccctttttggcctccaactgggcaccatgagggcctgcatctccctggtattggccgtgctgtgtggcctggcctgggctgacttgtactcggcacccacctcctgccagggccgctgctacgaagcctttgacaagcaccaccaatgtcactgcaatgcccgctgccaagagtttgggaactgctgcaaggattttgagagcctgtgtagtgaccacgaggtctcccacagcagtgatgccataacaaaagaggagattcagagcatctctgagaagatctacagggcagacaccaacaaagcccagaaggaagacatcgttctcaatagccaaaactgcatctccccgtcagagaccagaaaccaagtggatcgctgcccaaagccactcttcacttatgtcaatgagaagctgttctccaagcccacctatgcagccttcatcaacctcctcaacaactaccagcgggcaacaggccatggggagcacttcagtgcccaggagctggccgagcaggacgccttcctcagagagatcatgaagacagcagtcatgaaggagctctacagcttcctccatcaccagaatcgctatggctcagagcaagagtttgtcgatgacttgaagaacatgtggtttgggctctattcaagaggcaatgaagagggggactcgagtggctttgaacatgtcttctcaggtgaggtaaaaaaaggcaaggttactggcttccataactggatccgcttctacctggaggagaaggagggtctggttgactattacagtcacatctacgatgggccttgggattcttaccccgatgtgctggcaatgcagttcaactgggacggctactataaggaagtgggctctgctttcatcggcagcagccctgagtttgagtttgcactctactccctgtgcttcatcgccaggccaggcaaagtgtgccagttaagcctgggaggatatcccttagctgtccggacatatacctgggacaagtccacctatgggaatggcaagaagtacatcgccacagcctacatagtgtcttccacctaatagaacttcgagccagaaaggggcatgagggctcttgcgagactgaagtgctatcttctctggactagagagaagagggagaggactggaagggatcaccaaatctcaaagcaatgagaagcattcctaaatcccaaagtgcccacatgggaaagagataaaatgtacaaattagaaaaatgtggataaacagtcaaacctttatcctctagaattttggcaatgttgactaagaaacagagtccaagcagagaaggtaggaaccctccatagctctctgccctgatgtgtgggggaactaggaagaagtcctttgacctcaccaggcctcatgcttccctttaatgt

SEQ ID NO: 129725 - DNA, 4765 bp, Homo sapiens
  Payload ID: 5373
  Gene Symbol: EEPD1
  Gene Name: endonuclease/exonuclease/phosphatase family domain containing 1
  Uniprot ID: Q7L9B9
  ENST ID: ENST00000242108
  CDS Start-End: 719-2428
ccctcccccacgtgccctcgggagtcccggggaggagttgccgcgcggaggaggcgtggccgcggtgcctgcggaggcgcgagcggcgcggcgcggcgcggccgggactttggctttgacaccgactgcgagcgggagccgtgcggctggtgctgggtctggactggctctggcggatccccgcccgagttgggcgcaggactttttgccggggtaaacgcaactgcggcggcgccgccgcaagccccggtgcagcctcggcggcgggtttcgccgccgctgccgccgcctccgagcagccctgcggcttctattcactctgggagagcgatgctaagtttctcccatagaaagagccgggacacgcagaccgaagcggcgtagtcggcttccagggcctgaccagtgacccacacccgcgcggacgcctaggctggaggcagggggcccgtgctgtcccgggctgggctcaggcttccgagccgcaggtggaagaggaaccggcgccccgcagagcggccgagaggcggccaagtgaaaggtaattttggacacgccaggcatggaagattcggtgtttgtctatagtaacctcttcagtccctgaatcctgcaccttccgtttttctgtgcttgtacggcctactgggcttcctccctagccagagagctcttctgcagtggtgcggccttcccgggagcctgatcctggcggaccatggggagcaccctgggctgccaccgctccatccccagggacccctcggacctgtcccatagccgcaagttcagcgcagcctgtaacttcagcaacattctagtgaatcaggagcggctcaacatcaacactgccacggaggaggagctgatgaccctgcctggggtgacgcgtgccgtggcacgcagcatcgtggagtaccgagagtatatcggtggcttcaagaaggtggaggacctggcattggtcagtggtgtaggcgccaccaagctggagcaggtcaagtttgagatctgtgtgagcagcaagggcagctcagcgcagcactctcccagttccctgcggcgggacctgctagcggagcagcagcctcaccacctggccacagctgtgcccctcaccccacgtgttaacatcaacacagccaccccggcccagctcatgagcgtgcgaggcctctcggagaaaatggccctcagcatcgtggacttccgccgtgagcatgggccctttcgcagcgttgaggacctagtgaggatggatggtatcaatgccgccttcctggacaggatccggcaccaggtgtttgctgagaggtccaggcccccatccacccacacgaacgggggactgaccttcaccgccaagcctcacccgagccccacttccctgagcctgcagagtgaggacctggacctgccgccaggggggcccacccagattatctccactcggccgtccgtggaggcctttggaggcacaagggatgggaggcctgtgctgaggctggccacctggaacttgcagggctgttccgtggagaaggccaacaaccccggggtgcgagaggtggtgtgcatgacactcctggaaaacagcatcaagcttctagctgtgcaagaactgcttgacagagaggccttggaaaagttctgcacggagctaaaccagccgaccctgcccaacatccgcaagtggaaggggccccggggatgctggaaggctgttgttgctgagaagccctcgagtcagctccagaagggagctgggtatgcaggattcctatgggacgcggctgccggcatggagctgagagacgcgggttcacaggagagctcgccaagcaacgggcacgggaagctggcgggccccagcccatacctcgggaggttcaaggtgggaagtcacgacctgacccttgttaaccttcacctggcagccctgaccctcctggggagcgagaatcccagcaagaatcacagtgatggccaccggttggcgagctttgcacagaccctacaggaaaccctgaaaggagaaaaggatgtcattatcttaggggattttggccaagggccagacagcaatgactatgatatcctgaggaaagaaaagttccaccacctgatccccgcgcacaccttcaccaacatcagcaccaagaaccctcaaggctcgaagtctctggacaacatctggatcagtaaaagcttaaagaaggttttcacaggtcactgggctgtggtgagagaaggcctcacgaacccttggattccggataactggtcttggggcggggtggcttctgaacactgcccagtgctagccgagttctacactgaaaaggactggagcaagaaggatgcccctcggaacggcagcggggtggccttggagcgaagtgaagccaacatcaagcacgagcgatgatgacaccaaatccatgtgtccaccctgggacccaggagggcacagccaaggaatgagccctgtggggtgacgcttcagggcagagctgccttttaatttttattctcagagcatcagcacttgaggccttgccccacgccttctctgtggaccattcaggacctccagtgggggtggcgtgccaggcgcgtaccccaccaggtgggcaaagcagaaacctgcggggagcggagacgccttttatctctggatgccacagacctgagcagcattgggctggctgtccgctgctgactggatggcagcacaaagacaatatgagcagagggaggagaagaaggggtgctcaggctgcgggccacagtccagcagcgccagaagcactcatttctgaccaccaggctatgacgttcctgctgcgcattacagaaagcttttaactgtgatcaggcactctgctcagatacattgagtggcgatttttagttttgttttgaaaaaataaacagattaacctgcctcgctgcagtgagagcatgggacaagtccgccacagccctcccccgcccccttcccccgccccccaacgcgcagtgtgtatttgcaccacggcaggtgcctctgtgtggagctagggtcaagccctgagcagcttcacttcccctgcgccttttatgtccccaccttgaggccttgcagaggcgcctctcaaggccccatcagctcgccgggacctctgtgaagcctctctgtcatctccccttcccagcccctccttcatcccctgcctccttcaccagcctggcttttgcctggagcactatttgtttagttctctttgcaggacaagaattctctcagggtggtatcacctcctccctcctccccactcactccagtttttagcccggagcctcctgtggttgactatcaggaatgtgtgctgtgtcaggatacataggaagttgacctcggggtatcatggagagtgtccctcctagtggctggaggtagggacagttggttgtggggctggagagaggttgtggggaggaagcgaggatgcgtgcctgccactaggcatctgcatccccgagcccaagccaggagggatttcccttaggcaacaccatcccagggagatctgccacaatttgcgtttcacagctgaagacgctgaggcttagagagctcgacctcctcaaggtcacaccactgggtaaatagagggatgcagactcaggttttgctatgtgctcacatttcaactttatgcttaacatgaatggaaaaatatgaaagtaaatagtgaaaaggtaagttatgagcttagattacctagattattccagtatcccatggaagctgaggacttattccgctttccacaccgaacactaaatgtggaccagtatcaagaaccctcctgtccccacgcagtgtaaacccagtggcttctctgacctggagctgatgggccgtgaagggggcctatttttctccaaaggccatccttttggggccacctggctccaagaagcatcgctggtcttggggacgggaagggaaccctcttccaggagctctaagggtacttgggaatcaattgtgtccattctgaggtctctccagtgggagggcggcagctcctgtccctgggttcaggctgtgcttctggaagcatcgaaatgggatgtctgagccttgaggaaaagcagcagggttagcattaaagtcaagaggggcagctcaggatgctaccagggagcacatcgtttctggtgcctcatctaaaggtgaaacctcccctacattcaccagccggatgtcccaaatccctttagccagattgctttttgcaaccaaagctgtggacagaaaagcctccttaagtgagctgaggggacaggaaatccaatcagatgacctttgtgttcgtaatcgggcttgagccagaggctggggagctgagtcccagccaaacctcactggcccttttgcttttcacgcccagggctcagtggcccaggaagtgtgctgggcagcctgttcttactccagctcaacccattgggtgttggctgtttttggttttagttgttgttttgtattttgttgttttaattaataggctttatttgtaagagcagttttatgtttacagaaaaattaggcacaaagggattcccatatccctcctcttctttgcatatttccccctctaattagcatgttgcattagcatggcactttgttacaactgatgaacttgtattcattattagctacagtgttcatagtttatattaaagttcactctttgtgttgtgcatccta

SEQ ID NO: 129726 - DNA, 622 bp, Homo sapiens
  Payload ID: 5373
  Gene Symbol: EEPD1
  Gene Name: endonuclease/exonuclease/phosphatase family domain containing 1
  ENST ID: ENST00000444777
  CDS Start-End: 1-103
ggacaacatctggatcagtaaaagcttaaagaaggatgcccctcggaacggcagcggggtggccttggagcgaagtgaagccaacatcaagcacgagcgatgatgacaccaaatccatgtgtccaccctgggacccaggagggcacagccaaggaatgagccctgtggggtgacgcttcagggcagagctgccttttaatttttattctcagagcatcagcacttgaggccttgccccacgccttctctgtggaccattcaggacctccagtgggggtggcgtgccaggcgcgtaccccaccaggtgggcaaagcagaaacctgcggggagcggagacgccttttatctctggatgccacagacctgagcagcattgggctggctgtccgctgctgactggatggcagcacaaagacaatatgagcagagggaggagaagaaggggtgctcaggctgcgggccacagtccagcagcgccagaagcactcatttctgaccaccaggctatgacgttcctgctgcgcattacagaaagcttttaactgtgatcaggcactctgctcagatacattgagtggcgatttttagttttgttttgaaaaaataaacagattaacctgc

SEQ ID NO: 129727 - DNA, 2769 bp, Homo sapiens
  Payload ID: 5373
  Gene Symbol: EEPD1
  Gene Name: endonuclease/exonuclease/phosphatase family domain containing 1
  Uniprot ID: Q7L9B9
  ENST ID: ENST00000534978
  CDS Start-End: 541-2250
caccgactgcgagcgggagccgtgcggctggtgctgggtctggactggctctggcggatccccgcccgagttgggcgcaggactttttgccggggtaaacgcaactgcggcggcgccgccgcaagccccggtgcagcctcggcggcgggtttcgccgccgctgccgccgcctccgagcagccctgcggcttctattcactctgggagagcgatgctaagtttctcccatagaaagagccgggacacgcagaccgaagcggcgtagtcggcttccagggcctgaccagtgacccacacccgcgcggacgcctaggctggaggcagggggcccgtgctgtcccgggctgggctcaggcttccgagccgcaggtggaagaggaaccggcgccccgcagagcggccgagaggcggccaagtgaaaggtaattttggacacaccttccgtttttctgtgcttgtacggcctactgggcttcctccctagccagagagctcttctgcagtggtgcggccttcccgggagcctgatcctggcggaccatggggagcaccctgggctgccaccgctccatccccagggacccctcggacctgtcccatagccgcaagttcagcgcagcctgtaacttcagcaacattctagtgaatcaggagcggctcaacatcaacactgccacggaggaggagctgatgaccctgcctggggtgacgcgtgccgtggcacgcagcatcgtggagtaccgagagtatatcggtggcttcaagaaggtggaggacctggcattggtcagtggtgtaggcgccaccaagctggagcaggtcaagtttgagatctgtgtgagcagcaagggcagctcagcgcagcactctcccagttccctgcggcgggacctgctagcggagcagcagcctcaccacctggccacagctgtgcccctcaccccacgtgttaacatcaacacagccaccccggcccagctcatgagcgtgcgaggcctctcggagaaaatggccctcagcatcgtggacttccgccgtgagcatgggccctttcgcagcgttgaggacctagtgaggatggatggtatcaatgccgccttcctggacaggatccggcaccaggtgtttgctgagaggtccaggcccccatccacccacacgaacgggggactgaccttcaccgccaagcctcacccgagccccacttccctgagcctgcagagtgaggacctggacctgccgccaggggggcccacccagattatctccactcggccgtccgtggaggcctttggaggcacaagggatgggaggcctgtgctgaggctggccacctggaacttgcagggctgttccgtggagaaggccaacaaccccggggtgcgagaggtggtgtgcatgacactcctggaaaacagcatcaagcttctagctgtgcaagaactgcttgacagagaggccttggaaaagttctgcacggagctaaaccagccgaccctgcccaacatccgcaagtggaaggggccccggggatgctggaaggctgttgttgctgagaagccctcgagtcagctccagaagggagctgggtatgcaggattcctatgggacgcggctgccggcatggagctgagagacgcgggttcacaggagagctcgccaagcaacgggcacgggaagctggcgggccccagcccatacctcgggaggttcaaggtgggaagtcacgacctgacccttgttaaccttcacctggcagccctgaccctcctggggagcgagaatcccagcaagaatcacagtgatggccaccggttggcgagctttgcacagaccctacaggaaaccctgaaaggagaaaaggatgtcattatcttaggggattttggccaagggccagacagcaatgactatgatatcctgaggaaagaaaagttccaccacctgatccccgcgcacaccttcaccaacatcagcaccaagaaccctcaaggctcgaagtctctggacaacatctggatcagtaaaagcttaaagaaggttttcacaggtcactgggctgtggtgagagaaggcctcacgaacccttggattccggataactggtcttggggcggggtggcttctgaacactgcccagtgctagccgagttctacactgaaaaggactggagcaagaaggatgcccctcggaacggcagcggggtggccttggagcgaagtgaagccaacatcaagcacgagcgatgatgacaccaaatccatgtgtccaccctgggacccaggagggcacagccaaggaatgagccctgtggggtgacgcttcagggcagagctgccttttaatttttattctcagagcatcagcacttgaggccttgccccacgccttctctgtggaccattcaggacctccagtgggggtggcgtgccaggcgcgtaccccaccaggtgggcaaagcagaaacctgcggggagcggagacgccttttatctctggatgccacagacctgagcagcattgggctggctgtccgctgctgactggatggcagcacaaagacaatatgagcagagggaggagaagaaggggtgctcaggctgcgggccacagtccagcagcgccagaagcactcatttctgaccaccaggctatgacgttcctgctgcgcattacagaaagcttttaactgtgatcaggcactctgctcagatacattgagtggcgatttttagttttgttttgaaaaaataaacagattaacctgc

SEQ ID NO: 129728 - DNA, 5495 bp, Homo sapiens
  Payload ID: 5374
  Gene Symbol: ERAP1
  Gene Name: endoplasmic reticulum aminopeptidase 1
  Uniprot ID: Q9NZ08
  ENST ID: ENST00000296754
  CDS Start-End: 259-3105
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaatgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatga

SEQ ID NO: 129729 - DNA, 4805 bp, Homo sapiens
  Payload ID: 5374
  Gene Symbol: ERAP1
  Gene Name: endoplasmic reticulum aminopeptidase 1
  Uniprot ID: Q9NZ08
  ENST ID: ENST00000443439
  CDS Start-End: 68-2893
gcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcctcgaaagactctgaatagtcgactactgaacaatgaacacctggatctgagactaagccggacgatgactgggttaaagctctcccggctcacccctccagacccgctgcccatccctcttccttgctccatgcccaggggctgacttgtaaaggccaagtcatcaagctttcttgccctttggatgttggtcagtggggagccggagagctggagctggggtcggaggaggtagtaggtggaggtgttcttccctgattcccttgcgggatgcctcgggctggcctcccctgagggtcttagctccgagaggggaccctcttttccacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgagtgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaactttttgaatataaggcaaaaacttcaagataagggaatatgattgatgattggtacgaaaaatgtcaaaatgtgttcccctaatacacgacaaaatagagtgacttctggacataaatctgccatttattaaaccattcactacaacaaataaataggtataaaagtggaattggaatttttatacttatttgttgtagtgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctctaa

SEQ ID NO: 129730 - DNA, 583 bp, Homo sapiens
  Payload ID: 5374
  Gene Symbol: ERAP1
  Gene Name: endoplasmic reticulum aminopeptidase 1
  ENST ID: ENST00000507154
  CDS Start-End: 197-583
agctaggccggcggcagtggtggtggcggcggcgcaagggtgagggcggccccagaaccccagacagagtcttgctctgttgccaggctggagtgcagtggtgcaatctcagctcactgcaactctgcctcccaggttcaagcgattctcctgcctcagcctcccaagtaattaggactacaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggag

SEQ ID NO: 129731 - DNA, 555 bp, Homo sapiens
  Payload ID: 5374
  Gene Symbol: ERAP1
  Gene Name: endoplasmic reticulum aminopeptidase 1
  ENST ID: ENST00000508227
  CDS Start-End: 529-555
agctaggccggcggcagtggtggtggcggcggcgcaagggtgagggcggccccagaaccccagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacct

SEQ ID NO: 129732 - DNA, 632 bp, Homo sapiens
  Payload ID: 5374
  Gene Symbol: ERAP1
  Gene Name: endoplasmic reticulum aminopeptidase 1
  ENST ID: ENST00000512852
  CDS Start-End: 1-434
ttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcctcgaaagactctgaatagtcgactactgaacaatgaacacctggatctgagactaagccggacgatgactgggttaaagctctcccggctcacccctccagacccgctgcccatccctcttcctt

SEQ ID NO: 129733 - DNA, 551 bp, Homo sapiens
  Payload ID: 5374
  Gene Symbol: ERAP1
  Gene Name: endoplasmic reticulum aminopeptidase 1
  ENST ID: ENST00000503921
  CDS Start-End: 92-94
agctaggccggcggcagtggtggtggcggcggcgcaagggtgagggcggccccagaaccccagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggtgaaatctgtgactgttgctgaaggactcatagaagaccattttgatgtcactgtgaagatg

SEQ ID NO: 129734 - DNA, 3219 bp, Homo sapiens
  Payload ID: 5375
  Gene Symbol: ERAP2
  Gene Name: endoplasmic reticulum aminopeptidase 2
  Uniprot ID: Q6P179
  ENST ID: ENST00000379904
  CDS Start-End: 145-2892
atctgcagcagcatgatttaagattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcctggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatgctcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagccccgcacttctcgaaggtctgagttacttggaatcgttttaccacatgatggacagaaggaatatttcagatatctctgaaaacctcaagcgttaccttcttcagtattttaagccagtgattgacaggcaaagctggagtgacaagggctcagtctgggacaggatgctccgctcggctctcttgaagctggcctgtgacctgaaccatgctccttgcatccagaaagctgctgaactcttctcccagtggatggaatccagtggaaaattaaatataccaacagatgttttaaagattgtgtattctgtgggtgctcagacaacagcaggatggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtgaaactattttttgaatctcttgaggctcaaggatcacatctggatatttttcaaactgttctggaaacgataaccaaaaatataaaatggctggagaagaatcttccgactctgaggacttggctaatggttaatacttaaatggtcaatagaaaaagtaggctgggcgcggtggctcacgcctgtaatcccagcactttgggaggctgagaagggcggatcacgaggtcaggagatggagaccatcctggctaacacggtgagaccccgtctccgctaaaaatacaaaaaattagccgggcatggtggcaggtgcctgtagtcccagctactcggcaggctgcagcaggaaaatggcataaacccgggaggtggagcttgcagtgagccgagattgcaccactgcattccagcctgggtgactgagcgagactctgtctcaaaaaaaaaaaaaaaaaaaaaaagaaa

SEQ ID NO: 129735 - DNA, 5705 bp, Homo sapiens
  Payload ID: 5375
  Gene Symbol: ERAP2
  Gene Name: endoplasmic reticulum aminopeptidase 2
  Uniprot ID: Q6P179
  ENST ID: ENST00000437043
  CDS Start-End: 712-3594
cccaactcaaacaggcagataaagagagatcaaagagatgagcatgagatacagtcccctcgtgcccaaggagacagggtggttacagacatggaaaatctgagaataatcacctctgataaagatcacagaagctgcccgggaggtgtttggtaagcttggagttacgtttgtggggtggatgggcagaagtcagatttcatagcactgaggatgcagcacaaggagaagttcaagatcaattcctaagacaacaacttggcactaaaaaacataaactatgttctgaaggctttaccctggggacaagggaagggaggtgataacagcagaagtggcagccactggcgatcctttctttccatggtttggcttctactccaaagccacttatttgtgcattctacaaaaagtttcttgtcctttttgaaataaagctcttatcctaagctccattcacacctgcgtgataatgaaccagctagtacttactgtactcaggaagcatgcaaagttctgaatcttagaacagaaagtgaaagcaaaagtaaattccccttcagtcaaatctgcagcagcatgatttaagattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcctggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatgctcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagccccgcacttctcgaaggtctgagttacttggaatcgttttaccacatgatggacagaaggaatatttcagatatctctgaaaacctcaagcgttaccttcttcagtattttaagccagtgattgacaggcaaagctggagtgacaagggctcagtctgggacaggatgctccgctcggctctcttgaagctggcctgtgacctgaaccatgctccttgcatccagaaagctgctgaactcttctcccagtggatggaatccagtggaaaattaaatataccaacagatgttttaaagattgtgtattctgtgggtgctcagacaacagcaggatggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtgaaactattttttgaatctcttgaggctcaaggatcacatctggatatttttcaaactgttctggaaacgataaccaaaaatataaaatggctggagaagaatcttccgactctgaggacttggctaatggttaatacttaaatggtcaatagaaaaagtaggctgggcgcggtggctcacgcctgtaatcccagcactttgggaggctgagaagggcggatcacgaggtcaggagatggagaccatcctggctaacacggtgagaccccgtctccgctaaaaatacaaaaaattagccgggcatggtggcaggtgcctgtagtcccagctactcggcaggctgcagcaggaaaatggcataaacccgggaggtggagcttgcagtgagccgagattgcaccactgcattccagcctgggtgactgagcgagactctgtctcaaaaaaaaaaaaaaaaaaaaaaagaaaaagaaaaagaaaagaaaagaaaaggtacatcagacatgactgcctgcatgaagtcaaacagggtaacaccagtgaagctcaagtcaagagctgtggatattttgtctaaccaacaagaagtctcaagaaatcaggcagtgcagctgcctgctctcagctatcgtatccagccaaaagatgcatgatgatggagtggtgggggaaggccagttcagtatcctatttaaaagtaaacttcctgaataatggatatatgtggagatacagacatagatatatagatacagctgtaattatttagcctcaagtgactttctccattgcttcacgctatgccactattttgcttctttaatttttttaaccttgcttagtattctatagtttgcccaaccagttttacgtccaaggaaaattagccaatgcataaaatatacaaactatgaaaggcaaggatcaggaaaccagagactttgccaccaaatctcagattattagaaactaggtgtcagggtttatcaagaaggccaggaaggccttttgggttaagccttacattcatgaagaacctcaagggtagatttttgagagcattccaaatgaatggtctctggtcaaatgaatgaatggtcaaatgaataaatctgccctcacagagatacaaaaggaaaaggaatataattcataccatttggtttaagccttacattcatgaagtacctcaagggtagatttttgagatcattccaaatgaagtcgaatctgccctcacagagacacaagaaaggaatataattcatacactattgcatttttaataaatcttttgaaatttgcagaattagattgtattgtgtattttcggttaaatgataattgaatgtaaatatttagatgcagcaccatattttataacccagctttagcatttcttcatattttaaggaaaccccccacctccttcttttaagggcgcttcttgctctctgaaatgccctgctaaatgcttctcttaattatttgaataaggtagtttggaataaagaaagaaaagatcactctacatacagatagtaaacttaatttgtgatcctatatatgagacagtataaaaatacagataagttttagaaagactcaaaacaatatgtaaatgactgatgtttgcattattaaggaagacttgggatgttgggtcaagaggggaaagtgttagtcaatccactttggagcaatatcatgaaggtcaattataattccatatacctttctttgatgccacagtcagagatagaatacagtttgggtggccatggatgtgccccaatacagtacacattttttggttaaatttgttttcagatcatttcatggaatctttgaagtatctttgactctaactttgacttggtggtggaccttccttggtttttataacacctaagagatatcctttagaattacatgtattttagcataaggaaattgaaaaagtaaaacatactggtttttttcaacaagaccatatgtaaattaaatagtgaaatgtgtatgagtttcagtagaactgtaccatcaacaatgtttccataaatatgcagagttctttcttttgtattgttatttacaatattgttaaattgaatgcatttgcaatttctaggattctaaagaattgagtacagaaagtagcaattttattatttgatgataatatgagaattactgtgccaatactgttttgataaataaatagatttttaaaaataaatgtattgtactta

SEQ ID NO: 129736 - DNA, 2309 bp, Homo sapiens
  Payload ID: 5375
  Gene Symbol: ERAP2
  Gene Name: endoplasmic reticulum aminopeptidase 2
  ENST ID: ENST00000510373
  CDS Start-End: 228-2309
gatacagtcccctcgtgcccaaggagacagggtggttacagacatggaaaatctgagaataatcacctctgataaagatcacagaagctgcccgggaggtgtttgattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcctggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatgctcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagcccc

SEQ ID NO: 129737 - DNA, 3434 bp, Homo sapiens
  Payload ID: 5375
  Gene Symbol: ERAP2
  Gene Name: endoplasmic reticulum aminopeptidase 2
  Uniprot ID: Q6P179
  ENST ID: ENST00000513084
  CDS Start-End: 151-1749
agtcaaatctgcagcagcatgatttaagattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcctggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatggtaaggataaagagagtcacagagtagaagagatctgtggaatagcctgacctagactcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagccccgcacttctcgaaggtctgagttacttggaatcgttttaccacatgatggacagaaggaatatttcagatatctctgaaaacctcaagcgttaccttcttcagtattttaagccagtgattgacaggcaaagctggagtgacaagggctcagtctgggacaggatgctccgctcggctctcttgaagctggcctgtgacctgaaccatgctccttgcatccagaaagctgctgaactcttctcccagtggatggaatccagtggaaaattaaagtagatgtagacttctgtcctaccctttgttcttttctctttgattataccaacagatgttttaaagattgtgtattctgtgggtgctcagacaacagcaggatggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtgaaactattttttgaatctcttgaggctcaaggatcacatctggatatttttcaaactgttctggaaacgataaccaaaaatataaaatggctggagaagaatcttccgactctgaggacttggctaatggttaatacttaaatggtcaatagaaaaagtaggctgggcgcggtggctcacgcctgtaatcccagcactttgggaggctgagaagggcggatcacgaggtcaggagatggagaccatcctggctaacacggtgagaccccgtctccgctaaaaatacaaaaaattagccgggcatggtggcaggtgcctgtagtcccagctactcggcaggctgcagcaggaaaatggcataaacccgggaggtggagcttgcagtgagccgagattgcaccactgcattccagcctgggtgactgagcgagactctgtctc

SEQ ID NO: 129738 - DNA, 282 bp, Homo sapiens
  Payload ID: 5375
  Gene Symbol: ERAP2
  Gene Name: endoplasmic reticulum aminopeptidase 2
  ENST ID: ENST00000512869
  CDS Start-End: 1-238
aggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtttgtgactttctgtttttaacaatttcaaaataaatgttcaaattgtggaattgaaagtaaacttagatataatctga

SEQ ID NO: 129739 - DNA, 1275 bp, Homo sapiens
  Payload ID: 5375
  Gene Symbol: ERAP2
  Gene Name: endoplasmic reticulum aminopeptidase 2
  Uniprot ID: Q6P179
  ENST ID: ENST00000510309
  CDS Start-End: 123-1175
attaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcctggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactgggtatgttcaaattccacattattgtcttcatttttgctcataaaacttgctttgatctcttccctctttctctttctatgtgatttaaatgagcactgaggaattcagttagctcaggaaaaaataatttgttcctcagagatgattcttgagtgtagaaaataaaatatttatgacatgccc

SEQ ID NO: 129740 - DNA, 582 bp, Homo sapiens
  Payload ID: 5375
  Gene Symbol: ERAP2
  Gene Name: endoplasmic reticulum aminopeptidase 2
  ENST ID: ENST00000507346
  CDS Start-End: 496-582
taattcagttgactgggcagggaagtgtttgttgaggaagtgaatttaaattgagagctgagtttttttttaaagagacagttatgagaacatctcggggcaagtgctctaaagtgggattggttgaggaaggccagtgtaagctgaggagagcgaacaagagggagaaagggatcagatcatgtggagccttggggcgtcttgtaaggagttttgactttaactcagatgaaatgggaaatcactggaggattctgctctgatttatgctttataaagatcaagtctatgttgagggtatgttatagagaagcagagtaatcaattgggaggtcattgcagtagttcaggtaagaagtgatgctaatttgggccaggctagtggcagtgcttatggagtgaaacaattgaacttggcagttattttggagggcaaaacaacagagattgctgacatattggtcatgtgaggtgagggaaatagaagaatcaaggatgcttcatagagtggacggcttggtttcccagggccaggatccatctgggagaattcttgcagtaacagattttgagccaacccag

SEQ ID NO: 129741 - DNA, 489 bp, Homo sapiens
  Payload ID: 5375
  Gene Symbol: ERAP2
  Gene Name: endoplasmic reticulum aminopeptidase 2
  ENST ID: ENST00000508077
  CDS Start-End: 1-489
tcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttggagcttgtattttgaatatgctcaaggattttctgggtgaggagaaattccagaaaggaataattcagtacttaaagaagttcagctatagaaatgctaagaatgatgacttgtggagcagtctgtcaaa

SEQ ID NO: 129742 - DNA, 2433 bp, Homo sapiens
  Payload ID: 5376
  Gene Symbol: ERLEC1
  Gene Name: endoplasmic reticulum lectin 1
  Uniprot ID: Q96DZ1
  ENST ID: ENST00000185150
  CDS Start-End: 132-1583
ggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagaggaagatttgcaatcaactaaagaagagagatttccagcgatccacaagtcgattgctattggctctcagccagtgctcactgttgggacaacccacatatccaaattgacagatgaccaactcataaaagagtttcttagtggttcttactgctttcgtgggggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggatggtgtcacatttttatggaaatggagatatttgtgatataactgacaaaccaagacaggtgactgtaaaactaaagtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaagcagtgttgtcatgtagtcaatggca

SEQ ID NO: 129743 - DNA, 2271 bp, Homo sapiens
  Payload ID: 5376
  Gene Symbol: ERLEC1
  Gene Name: endoplasmic reticulum lectin 1
  Uniprot ID: Q96DZ1
  ENST ID: ENST00000378239
  CDS Start-End: 132-1421
ggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagagggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggatggtgtcacatttttatggaaatggagatatttgtgatataactgacaaaccaagacaggtgactgtaaaactaaagtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaagcagtgttgtcatgtagtcaatggca

SEQ ID NO: 129744 - DNA, 1756 bp, Homo sapiens
  Payload ID: 5376
  Gene Symbol: ERLEC1
  Gene Name: endoplasmic reticulum lectin 1
  Uniprot ID: Q96DZ1
  ENST ID: ENST00000405123
  CDS Start-End: 132-1505
ggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagaggaagatttgcaatcaactaaagaagagagatttccagcgatccacaagtcgattgctattggctctcagccagtgctcactgttgggacaacccacatatccaaattgacagatgaccaactcataaaagagtttcttagtggttcttactgctttcgtgggggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatact

SEQ ID NO: 129745 - DNA, 5376 bp, Homo sapiens
  Payload ID: 5377
  Gene Symbol: ERMP1
  Gene Name: endoplasmic reticulum metallopeptidase 1
  Uniprot ID: Q7Z2K6
  ENST ID: ENST00000339450
  CDS Start-End: 91-2805
aggaggcgctgcggcagcgacggcggcgtcggcggcggccggggctgtcgcgggttggggcggttgggctggcagctgaggctcgtggccatggagtggggttctgagtcggctgctgtgaggcggcaccgcgtcggagtagagcgtcgagagggagcggcggccgcgccaccgccggagagggaggcccgagcgcaggagcctctggtggatgggtgcagcggcggcgggaggacgcggaagaggagccccgggggtagcggcggcgcgagcaggggcgcggggaccgggctgtctgaggtgcgcgccgcgctggggctcgcgctctacctgatcgcgctgcggacgctggtgcagctctcgctgcagcagctcgtgctacgcggggccgctggacaccgcggggagttcgacgcgctccaagccagggattatcttgaacacataacctccattggccccaggactacaggaagtccagaaaatgaaattctgaccgtgcactaccttttggaacagattaaactgattgaagtgcaaagcaacagccttcataagatttcagtagatgtacaacggcccacaggctcttttagcattgatttcttgggaggttttacaagctattatgacaacatcaccaatgttgtggtaaagctggaacccagagatggagcccagcatgctgtcttggctaattgtcattttgactcagtagcaaactcaccaggtgccagtgatgatgcagttagctgctcagtgatgctggaagtccttcgcgtcttgtcaacatcttcagaagccttgcatcatgctgtcatatttctctttaatggtgctgaggaaaatgtcttgcaagccagtcatggtttcattactcagcacccctgggctagcttgattcgtgcattcattaacctagaggcagcaggtgtaggagggaaagaacttgtattccaaacaggtcctgaaaatccttggttggttcaagcttatgtttcagcagctaaacacccttttgcttctgtggtggctcaggaggtttttcagagtggaatcattccttcagatactgactttcgtatctacagggattttgggaacattccaggaatagacttagcttttattgagaatggatacatttatcacaccaagtatgacacagcggacagaattctaacagattccattcagagagcaggtgacaacattttagcagttcttaagcatctagctacatctgatatgctggctgctgcttctaagtatcgacatggaaacatggtcttctttgatgtgctgggcctgtttgtcattgcctacccctctcgtattggctcaatcataaactacatggtggtaatgggtgttgttttgtacctgggcaaaaaatttttgcagcccaaacataagactggtaactacaagaaggacttcttgtgtggacttggcatcactttgatcagctggttcactagccttgttaccgttctcattatagcagtgttcatctctcttattggacagtctctctcatggtataaccacttctatgtctccgtttgtctgtatggaactgcaactgtagccaaaataatacttatacatactcttgcgaaaagattttattacatgaatgccagtgcccagtatctgggagaagtattttttgacatttcgctgtttgtccattgctgttttcttgttaccctcacttaccaaggactttgctcggcgtttattagtgctgtctgggtagcattcccattgctcacaaagctctgtgtgcataaggacttcaagcagcatggtgcccaaggaaaatttattgctttttaccttttggggatgtttattccttatctttatgcattgtacctcatctgggcagtatttgagatgtttacccctatcctcgggagaagtggttctgaaatcccacctgatgttgtgctggcatccattttggctggctgtacaatgattctctcgtcctattttattaacttcatctaccttgccaagagcacaaaaaaaaccatgctaactttaactttggtatgtgcaattacattcctccttgtttgcagtggaacattttttccatatagctccaatcctgctaatccgaagccaaagagagtgtttcttcagcatatgactagaacattccatgacttggaaggaaatgcagttaaacgggactctggaatatggatcaatgggtttgattatactggaatttctcacataacccctcacattcctgagatcaatgatagtatccgagctcactgtgaggagaatgcacctctttgtggttttccttggtatcttccagtgcactttctgatcaggaaaaactggtatcttcctgccccagaagtttctccaagaaatcctcctcatttccgactcatatccaaagaacagacaccttgggattctataaaattgacttttgaagcaacaggaccaagccatatgtccttctatgttcgagcccacaaagggtcaacactttctcagtggtctcttggcaatggcaccccagtcacaagtaaaggaggagactactttgtcttttactcccatggactccaggcctctgcatggcagttctggatagaagtgcaggtttcagaagaacatcctgaaggaatggtcaccgtggccattgctgcccactatctgtctggggaagacaagagatcccctcaactggatgctctgaaggaaaagttcccagattggacatttccctctgcctgggtgtgcacctacgatctctttgtattttaatcttgtggatgagctctaagtacatgcccagtggatactccatgtgacatggtttctccctatgttacgtggatgtttgtaacgtaagtcaatgaattttaatgatcatatgttcaaagagctttctgggttaacgcttttcagggccaagcactataagggtttagctgtggcgcagtgatgcatggcctgttgacacttgaaaatgccagtcttttggcacttcagcacatgtgggtactgccactacacacacgtcattttatatgaccttaaggacaaagccaacaatccacttcaatagctgcccctttaggatcaagaaagatgtacactgtcagagcattgttaatgagacaaaagttgtttccaatttaagccccaaaaccatttgttgtattagtggatggtgggtaaaatatcattcactgaggtaatgattccccttgagaatataactctgtgtaggtcactggaaagtgattgccatagggctgggagagaagcattgcactcttgaggctgtagcctgtgtcaagctgtttcttcaggcagcctctcaaatgtgctttgtctctctgtgctgaggcctggaccctgtgctgagctggtgactcactgtcctgacaagtggacacacagatgcactgctgtgctgctttcctgaggtggttttctatgcctgttttcctctgaaacatgtctgttacccctctccatcttaccaagttgaaaaggggaatatttggccacatacccctctggttttcgtaggttcttttggttcagaatattgtttgtgccagtacatgaccttaacttccttcctcagagcactgagctgccatctgggctattctggggtagaaggaaggctgggagtggtgggaattttataaatatttattctcttttctttgtttcataggagtcttgtgttatacaaggttagtccttcatggtataatcttactgatgcactgggcctatctttttgttttccagccagttgaatagattagtttttctcagtaacttactatccagcagactggctttcctgagacttgaggttgtggcttatactggaatgagaccactgtacgtgtaggtggttcagatcctgcgtaatggcagcatgaggacttaaaaggtggttttcattttgaagatggctatgtagcttgtaaggtgtatcacagcagtacctctcatggctttttggttccagcagtgagggcattggtgagatcaatggtaaactgtgcaagctttctttttatcattaggaaatgtgaaacgttggacaaattttgagttttaacaaggacaaaaagttgaaagaaaaggcacagttaacaaaaaagggtggctagatttatcttgggtgatggaggaaatgagagaggaatgctcttgaaaggtggtctgtggatctgtctgaatagaaagagcacagtaagtatgcattgccggagaaaacgtccttgaagctgcttgtctcatgtgtatgatgtgctttttaaatcatgcccctcgttgcctgcctaatctgtgactccctaaaaactaactgggcccatgtagatggggctgcaaccagagctgaataacatgttaggctcacacatgcatcagcactgcacactggaatcattgctcttcctggactttgtagaaatcagtctcaagtgcttcaagagtctggctcctgctacttttatctgtcaggtagcacataaggtttgcagggtttatattttgtatagaatcacagttgtggagaaaaagtaataatttctcaatgaattttaaaaatgggcctattttctatccccgtggttcatctgatataattagtgttccctgtgaattccccccctctatgggaaggatgcctttactctttatcagtaataaattatgactgttttcatattgccttagggttatttccctgtgtaaaccattgtcttttgttttggttttctttagcattatgaagctttggtattgtacaaggtcagtagtaagatgctcactagtctcagggcttgtgtaatattctgggaggtcatttaaatgccagaaatggtcaagcaattatacacagtatttatgactctgttaagcataccgtttgtctgtcacattagtagattctgagattaaaaaaaatttttaaagagtgatcatttaaataatttctaaaagggtcttttcaagctctaacaaagtcactaacaaatgcattattttctacagaattagatgttagtagtacagtactgcatattcagggaaaaagtgtgaggaattgatttcaaaatagttcgttcttgtgtttgacctaagaatgattgtcgcatgaagtgtttgtttttacagtttagcatatataaacaaacatgataggattccttaagatgttaccacccagggggccacaagccagcctgctgtctcaggaagctgtagaaggagtgtttgtcaatttcttgtcactggtttgctgacttactgaggattaattgttgccttacaatgttactgaaataaactgtttaatat

SEQ ID NO: 129746 - DNA, 3554 bp, Homo sapiens
  Payload ID: 5377
  Gene Symbol: ERMP1
  Gene Name: endoplasmic reticulum metallopeptidase 1
  Uniprot ID: Q7Z2K6
  ENST ID: ENST00000462592
  CDS Start-End: 44-2758
tcgcgggttggggcggttgggctggcagctgaggctcgtggccatggagtggggttctgagtcggctgctgtgaggcggcaccgcgtcggagtagagcgtcgagagggagcggcggccgcgccaccgccggagagggaggcccgagcgcaggagcctctggtggatgggtgcagcggcggcgggaggacgcggaagaggagccccgggggtagcggcggcgcgagcaggggcgcggggaccgggctgtctgaggtgcgcgccgcgctggggctcgcgctctacctgatcgcgctgcggacgctggtgcagctctcgctgcagcagctcgtgctacgcggggccgctggacaccgcggggagttcgacgcgctccaagccagggattatcttgaacacataacctccattggccccaggactacaggaagtccagaaaatgaaattctgaccgtgcactaccttttggaacagattaaactgattgaagtgcaaagcaacagccttcataagatttcagtagatgtacaacggcccacaggctcttttagcattgatttcttgggaggttttacaagctattatgacaacatcaccaatgttgtggtaaagctggaacccagagatggagcccagcatgctgtcttggctaattgtcattttgactcagtagcaaactcaccaggtgccagtgatgatgcagttagctgctcagtgatgctggaagtccttcgcgtcttgtcaacatcttcagaagccttgcatcatgctgtcatatttctctttaatggtgctgaggaaaatgtcttgcaagccagtcatggtttcattactcagcacccctgggctagcttgattcgtgcattcattaacctagaggcagcaggtgtaggagggaaagaacttgtattccaaacaggtcctgaaaatccttggttggttcaagcttatgtttcagcagctaaacacccttttgcttctgtggtggctcaggaggtttttcagagtggaatcattccttcagatactgactttcgtatctacagggattttgggaacattccaggaatagacttagcttttattgagaatggatacatttatcacaccaagtatgacacagcggacagaattctaacagattccattcagagagcaggtgacaacattttagcagttcttaagcatctagctacatctgatatgctggctgctgcttctaagtatcgacatggaaacatggtcttctttgatgtgctgggcctgtttgtcattgcctacccctctcgtattggctcaatcataaactacatggtggtaatgggtgttgttttgtacctgggcaaaaaatttttgcagcccaaacataagactggtaactacaagaaggacttcttgtgtggacttggcatcactttgatcagctggttcactagccttgttaccgttctcattatagcagtgttcatctctcttattggacagtctctctcatggtataaccacttctatgtctccgtttgtctgtatggaactgcaactgtagccaaaataatacttatacatactcttgcgaaaagattttattacatgaatgccagtgcccagtatctgggagaagtattttttgacatttcgctgtttgtccattgctgttttcttgttaccctcacttaccaaggactttgctcggcgtttattagtgctgtctgggtagcattcccattgctcacaaagctctgtgtgcataaggacttcaagcagcatggtgcccaaggaaaatttattgctttttaccttttggggatgtttattccttatctttatgcattgtacctcatctgggcagtatttgagatgtttacccctatcctcgggagaagtggttctgaaatcccacctgatgttgtgctggcatccattttggctggctgtacaatgattctctcgtcctattttattaacttcatctaccttgccaagagcacaaaaaaaaccatgctaactttaactttggtatgtgcaattacattcctccttgtttgcagtggaacattttttccatatagctccaatcctgctaatccgaagccaaagagagtgtttcttcagcatatgactagaacattccatgacttggaaggaaatgcagttaaacgggactctggaatatggatcaatgggtttgattatactggaatttctcacataacccctcacattcctgagatcaatgatagtatccgagctcactgtgaggagaatgcacctctttgtggttttccttggtatcttccagtgcactttctgatcaggaaaaactggtatcttcctgccccagaagtttctccaagaaatcctcctcatttccgactcatatccaaagaacagacaccttgggattctataaaattgacttttgaagcaacaggaccaagccatatgtccttctatgttcgagcccacaaagggtcaacactttctcagtggtctcttggcaatggcaccccagtcacaagtaaaggaggagactactttgtcttttactcccatggactccaggcctctgcatggcagttctggatagaagtgcaggtttcagaagaacatcctgaaggaatggtcaccgtggccattgctgcccactatctgtctggggaagacaagagatcccctcaactggatgctctgaaggaaaagttcccagattggacatttccctctgcctgggtgtgcacctacgatctctttgtattttaatcttgtggatgagctctaagtacatgcccagtggatactccatgtgacatggtttctccctatgttacgtggatgtttgtaacagggaccagatggcatacttagtgttttctgtaaactgaatttactggcaggaacattttcagctgactgggataaactgatgcttcgattcctgaagaactcaaatccaccacttgaactgggttcctaggattacacaccatatgcagtaccattagagaaagatgctacgtgggtgtatggcctagagaagatgtgtaacttttgcaactaacctgagctgtgggtgtggatggaggtgtctcagattctccagagccaatggctttaagaaatcgaatcatgtgtcgacaaaggtcccacttgccttgttctagtgctgtgttgaatagaagggtagcatgttgcctacttactgcagggacttccatattctacaaaaaacaaccaggacagcattctttttatactacacaatttgggaagatatgagcaattctttatctcgttttctaaactcaaagaatgtagccacaccaccacaggggttagtttaataataagattaaaaagtaccatacaaggaaaagcgaggcaagtactcttctggtgtatgtaaactataatttattaaactcctactacatgccagatagcatacatatactttaagtcatttcatttatttctcccagtgactctgcagataggcatatcatttgtattttacaagtgaggaaactgagttaagtaaattgttgaagatcagcag

SEQ ID NO: 129747 - DNA, 3293 bp, Homo sapiens
  Payload ID: 5377
  Gene Symbol: ERMP1
  Gene Name: endoplasmic reticulum metallopeptidase 1
  ENST ID: ENST00000489219
  CDS Start-End: 29-2554
gttgggctggcagctgaggctcgtggccatggagtggggttctgagtcggctgctgtgaggcggcaccgcgtcggagtagagcgtcgagagggagcggcggccgcgccaccgccggagagggaggcccgagcgcaggagcctctggtggatgggtgcagcggcggcgggaggacgcggaagaggagccccgggggtagcggcggcgcgagcaggggcgcggggaccgggctgtctgaggtgcgcgccgcgctggggctcgcgctctacctgatcgcgctgcggacgctggtgcagctctcgctgcagcagctcgtgctacgcggggccgctggacaccgcggggagttcgacgcgctccaagccagggattatcttgaacacataacctccattggccccaggactacaggaagtccagaaaatgaaattctgaccgtgcactaccttttggaacagattaaactgattgaagtgcaaagcaacagccttcataagatttcagtagatgtacaacggcccacaggctcttttagcattgatttcttgggaggttttacaagctattatgacaacatcaccaatgttgtggtaaagctggaacccagagatggagcccagcatgctgtcttggctaattgtcattttgactcagtagcaaactcaccaggtgccagtgatgatgcagttagctgctcagtgatgctggaagtccttcgcgtcttgtcaacatcttcagaagccttgcatcatgctgtcatatttctctttaatggtgctgaggaaaatgtcttgcaagccagtcatggtttcattactcagcacccctgggctagcttgattcgtgcattcattaacctagaggcagcaggtgtaggagggaaagaacttgtattccaaacaggtcctgaaaatccttggttggttcaagcttatgtttcagcagctaaacacccttttgcttctgtggtggctcaggaggtttttcagagtggaatcattccttcagatactgactttcgtatctacagggattttgggaacattccaggaatagacttagcttttattgagaatggatacatttatcacaccaagtatgacacagcggacagaattctaacagattccattcagagagcaggtgacaacattttagcagttcttaagcatctagctacatctgatatgctggctgctgcttctaagtatcgacatggaaacatggtcttctttgatgtgctgggcctgtttgtcattgcctacccctctcgtattggctcaatcataaactacatggtggtaatgggtgttgttttgtacctgggcaaaaaatttttgcagcccaaacataagactggtaactacaagaaggacttcttgtgtggacttggcatcactttgatcagctggttcactagccttgttaccgttctcattatagcagtgttcatctctcttattggacagtctctctcatggtataaccacttctatgtctccgtttgtctgtatggaactgcaactgtagccaaaataatacttatacatactcttgcgaaaagattttattacatgaatgccagtgcccagtatctgggagaagtattttttgacatttcgctgtttgtccattgctgttttcttgttaccctcacttaccaaggactttgctcggcgtttattagtgctgtctgggtagcattcccattgctcacaaagctctgtgtgcataaggacttcaagcagcatggtgcccaaggaaaatttattgctttttaccttttggggatgtttattccttatctttatgcattgtacctcatctgggcagtatttgagatgtttacccctatcctcgggagaagtggttctgaaatcccacctgatgttgtgctggcatccattttggctggctgtacaatgattctctcgtcctattttattaacttcatctaccttgccaagagcacaaaaaaaaccatgctaactttaactttggtatgtgcaattacattcctccttgtttgcagtggaacattttttccatatagctccaatcctgctaatccgaagccaaagagagtgtttcttcagcatatgactagaacattccatgacttggaaggaaatgcagttaaacgggactctggaatatggatcaatgggtttgattatactggaatttctcacataacccctcacattcctgagatcaatgatagtatccgagctcactgtgaggagaatgcacctctttgtggttttccttggtatcttccagtgcactttctgatcaggaaaaactggtatcttcctgccccagaagtttctccaagaaatcctcctcatttccgactcatatccaaagaacagacaccttgggattctataaaattgacttttgaagcaacagcctgcctgcctatccttcagattttggacttgccagcctcaacaatcatgaccaagccatatgtccttctatgttcgagcccacaaagggtcaacactttctcagtggtctcttggcaatggcaccccagtcacaagtaaaggaggagactactttgtcttttactcccatggactccaggcctctgcatggcagttctggatagaagtgcaggtttcagaagaacatcctgaaggaatggtcaccgtggccattgctgcccactatctgtctggggaagacaagagatcccctcaactggatgctctgaaggaaaagttcccagattggacatttccctctgcctgggtgtgcacctacgatctctttgtattttaatcttgtggatgagctctaagtacatgcccagtggatactccatgtgacatggtttctccctatgttacgtggatgtttgtaacgtaagtcaatgaattttaatgatcatatgttcaaagagctttctgggttaacgcttttcagggccaagcactataagggtttagctgtggcgcagtgatgcatggcctgttgacacttgaaaatgccagtcttttggcacttcagcacatgtgggtactgccactacacacacgtcattttatatgaccttaaggacaaagccaacaatccacttcaatagctgcccctttaggatcaagaaagatgtacactgtcagagcattgttaatgagacaaaagttgtttccaatttaagccccaaaaccatttgttgtattagtggatggtgggtaaaatatcattcactgaggtaatgattccccttgagaatataactctgtgtaggtcactggaaagtgattgccatagggctgggag

SEQ ID NO: 129748 - DNA, 2799 bp, Homo sapiens
  Payload ID: 5377
  Gene Symbol: ERMP1
  Gene Name: endoplasmic reticulum metallopeptidase 1
  ENST ID: ENST00000487088
  CDS Start-End: 839-1894
cggccgcgccaccgccggagagggaggcccgagcgcaggagcctctggtggatgggtgcagcggcggcgggaggacgcggaagaggagccccgggggtagcggcggcgcgagcaggggcgcggggaccgggctgtctgaggtgcgcgccgcgctggggctcgcgctctacctgatcgcgctgcggacgctggtgcagctctcgctgcagcagctcgtgctacgcggggccgctggacaccgcggggagttcgacgcgctccaagccaggtaccggccgctccctcctggcacggcccgcgcgtccgtttgcggctcctgcgcaggctccggggcaccgcacctgtgtgcacccgcccctgccggaccgctgggactcgctgacccctcccaggctgcacgtggggtggggtgaccttgcttgtccttcttctggggtctgaattgccgggacttggggcttgcctgtccccggttaagctcgtggtgcagattggggttgccagggattatcttgaacacataacctccattggccccaggactacaggaagtccagaaaatgaaattctgaccgtgcactaccttttggaacagattaaactgattgaagtgcaaagcaacagccttcataagatttcagtagatgtacaacggcccacaggctcttttagcattgatttcttgggaggttttacaagctattatgacaacatcaccaatgttgtggtaaagctggaacccagagatggagcccagcatgctgtcttggctaattgtcattttgactcagtagcaaactcaccaggtgccagtgatgatgcagttagctgctcagtgatgctggaagtccttcgcgtcttgtcaacatcttcagaagccttgcatcatgctgtcatatttctctttaatggtgctgaggaaaatgtcttgcaagccagtcatggtttcattactcagcacccctgggctagcttgattcgtgcattcattaacctagaggcagcaggtgtaggagggaaagaacttgtattccaaacaggtcctgaaaatccttggttggttcaagcttatgtttcagcagctaaacacccttttgcttctgtggtggctcaggaggtttttcagagtggaatcattccttcagatactgactttcgtatctacagggattttgggaacattccaggaatagacttagcttttattgagaatggatacatttatcacaccaagtatgacacagcggacagaattctaacagattccattcagagagcaggtgacaacattttagcagttcttaagcatctagctacatctgatatgctggctgctgcttctaagtatcgacatggaaacatggtcttctttgatgtgctgggcctgtttgtcattgcctacccctctcgtattggctcaatcataaactacatggtggtaatgggtgttgttttgtacctgggcaaaaaatttttgcagcccaaacataagactggtaactacaagaaggacttcttgtgtggacttggcatcactttgatcagctggttcactagccttgttaccgttctcattatagcagtgttcatctctcttattggacagtctctctcatggtataaccacttctatgtctccgtttgtctgtatggaactgcaactgtagccaaaataatacttatacatactcttgcgaaaagattttattacatgaatgccagtgcccagtatctgggagaagtattttttgacatttcgctgtttgtccattgctgttttcttgttaccctcacttaccaaggactttgctcggcgtttattagtgctgtctgggtagcattcccattgctcacaaagctctgtgtgcataaggacttcaagcagcatgattaacttcatctaccttgccaagagcacaaaaaaaaccatgctaactttaactttggtatgtgcaattacattcctccttgtttgcagtggaacattttttccatatagctccaatcctgctaatccgaagccaaagagagtgtttcttcagcatatgactagaacattccatgacttggaaggaaatgcagttaaacgggactctggaatatggatcaatgggtttgattatactggaatttctcacataacccctcacattcctgagatcaatgatagtatccgagctcactgtgaggagaatgcacctctttgtggttttccttggtatcttccagtgcactttctgatcaggaaaaactggtatcttcctgccccagaagtttctccaagaaatcctcctcatttccgactcatatccaaagaacagacaccttgggattctataaaattgacttttgaagcaacaggaccaagccatatgtccttctatgttcgagcccacaaagggtcaacactttctcagtggtctcttggcaatggcaccccagtcacaagtaaaggaggagactactttgtcttttactcccatggactccaggcctctgcatggcagttctggatagaagtgcaggtttcagaagaacatcctgaaggaatggtcaccgtggccattgctgcccactatctgtctggggaagacaagagatcccctcaactggatgctctgaaggaaaagttcccagattggacatttccctctgcctgggtgtgcacctacgatctctttgtattttaatcttgtggatgagctctaagtacatgcccagtggatactccatgtgacatggtttctccctatgttacgtggatgtttgtaacgtaagtcaatgaattttaatgatcat

SEQ ID NO: 129749 - DNA, 5285 bp, Homo sapiens
  Payload ID: 5378
  Gene Symbol: ERO1A
  Gene Name: endoplasmic reticulum oxidoreductase alpha
  Uniprot ID: Q96HE7
  ENST ID: ENST00000395686
  CDS Start-End: 225-1631
cgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcaaatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatcgtgccctctttacatatgtcttatcaggtataacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaataatttgtcctatttttctctgtcacttcctttttctctaaggcaggaaaggaaagacattaaaccattaattaagtcaatcctcttggagactcaaaagactatgaagtgatcactctatataaaatataaatacagtgtgggttcaaatggccattttttgtgtgtccctctctctcatcttatgcttcccttcctttttttatttttattttttggagacggagtcttgctgtgtcgcccaggttggagtgcagtggcgtgatcttagctcactgcaagctctgccttccaggttcacgccattcttctgcctcagccccctgagtagctgggactacaggcgcccgccaccacgcccggctaatttttttttttttttttttgtatttttagtagaggcagtgtttcaccgtgttagccaggatggtcttgatctcctgacctcgtgatccacccacctcgacctcccaaagtgctgggattacaggcgtgagccaccacgcccggcctcttttttttttagctgccaatctttttgaaggaatattcttacctctactttgtcaccttctactggctccttaactaaaatctgccatttggctctctggttaacagtcccttcctgtaaagtctaaaatcttaattctaaatccacagtttaattcacaagctagtacttgactttttttctgtatttgacatttttgacaacccctactttaaagatttattcccttgacttcttacattttgctcactcctgaaccaccccccaccttttggcctcttcatttattccttaaatgttattcctcagacctccattttttttttctctcttaatcacaacaccacttctcacgcttgggtaattttaattcagcagttcctaaatccttatctttagccagactcctcaatccatctgcctgttgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattttatctccacctctctgatacatcactctttcatcttcattgctattattaataaatacctacagtactaacctgcctcctatacctagctggtctcctctctgttgctcaatgttaccacagcaggctttctagaagcactctgacagtgttactccctaatatccttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtatgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattgattttaaagtgacatctttattatattagaggtcctacctatattccaaatactttcactcccttcactttacagcaagggtcagtagagtcccaaggatttgtagactttagggggtcaataaagctgaaattgtattca

SEQ ID NO: 129750 - DNA, 951 bp, Homo sapiens
  Payload ID: 5378
  Gene Symbol: ERO1A
  Gene Name: endoplasmic reticulum oxidoreductase alpha
  ENST ID: ENST00000556358
  CDS Start-End: 727-951
ttttttctagtttaaaaagcatgtaatgaatccttagttttcatggcatgaattgttatcaaggctaggtattttcccattcttgactgatttactatttaaattctgtattttgacctcctgtaaaacactttaaccagaacgttatgagactgggtcaacctaaggcaatgctaaagccttttaaagaccaagcagcaggctggtacttaactgaatccataacctttcttcttcctttcgagaaattgcaattaagacttggaccgttaggttaaataatctttacattgttgtttggcacaaatttgctataatgctttaaaacttttgaaaaacttgtattttggcatttttctattcttatgacttatttttcttttgatttcagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattt

SEQ ID NO: 129751 - DNA, 2094 bp, Homo sapiens
  Payload ID: 5378
  Gene Symbol: ERO1A
  Gene Name: endoplasmic reticulum oxidoreductase alpha
  ENST ID: ENST00000554019
  CDS Start-End: 408-1181
tgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaaggtaaattacttatttgcgtttcactgctttttcttaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaag

SEQ ID NO: 129752 - DNA, 1855 bp, Homo sapiens
  Payload ID: 5378
  Gene Symbol: ERO1A
  Gene Name: endoplasmic reticulum oxidoreductase alpha
  ENST ID: ENST00000556039
  CDS Start-End: 420-1193
tcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaaggtaaattacttatttgcgtttcactgctttttcttaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattg

SEQ ID NO: 129753 - DNA, 567 bp, Homo sapiens
  Payload ID: 5378
  Gene Symbol: ERO1A
  Gene Name: endoplasmic reticulum oxidoreductase alpha
  ENST ID: ENST00000556223
  CDS Start-End: 49-426
gtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaaggtgtgtacgtatacctattgatgtgtccagtatcttaatgaaaaacttgaaaaacccatttccgttgtacctactatcccatttatctgcttccagtggtgaaaccccttgagagtattctgaagaagccaataatctcattgaagaatgtgaacaagctga

SEQ ID NO: 129754 - DNA, 555 bp, Homo sapiens
  Payload ID: 5378
  Gene Symbol: ERO1A
  Gene Name: endoplasmic reticulum oxidoreductase alpha
  ENST ID: ENST00000554251
  CDS Start-End: 49-555
gtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgtttt

SEQ ID NO: 129755 - DNA, 998 bp, Homo sapiens
  Payload ID: 5378
  Gene Symbol: ERO1A
  Gene Name: endoplasmic reticulum oxidoreductase alpha
  ENST ID: ENST00000629528
  CDS Start-End: 225-998
cgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaaggtaaattacttatttgcgtttcactgctttttcttaggtctctgtgtagaaaaaagagcattctacagacttatatctggcctacatgcaagcattaa

SEQ ID NO: 129756 - DNA, 1177 bp, Homo sapiens
  Payload ID: 5379
  Gene Symbol: ERO1B
  Gene Name: endoplasmic reticulum oxidoreductase beta
  ENST ID: ENST00000264181
  CDS Start-End: 1-522
tggggacctaatattaaagaattcaaacaccgctttgaccctgtggaaaccaagggagaaggtccaagaaggctcaagaatctttactttttatacttgattgagcttcgagctttgtcaaaggtggctccatattttgagcgctcaattgtcgatctttacactggaaatgcagaagaagatgctgacacaaaaactcttctactgaatatctttcaagatacaaagtcctttcccatgcactttgatgagaaatccatgtttgcaggtgacaaaaaaggggccaagtcactaaaggaggaattccgattacatttcaagaatatctcccgtataatggactgtgttggatgtgacaaatgcagattatggggaaaattacagactcagggtttaggaactgccctgaagatattattctctgaaaaagaaatccaaaagcttccagagaatagtccatctaaaggcttccaactcacccgacaggaaatagttgctcttttaaatgcttttggaaggtaagaaccattatatgttgaagatttttgatttcccattgggtttcaacaaactgcaaagataatcttctttgctaaaagtagggtttgttttgttgacaaaaaaaaattttatattgtatctgtactaacttagagaggccttaatgctgacaagtcagtttctctacaggtcataggaaaaactaagtttccaattgccagtgtttttcagtttgctgccttaattttgtaagggagatattcttctaatattctttttgcttggctataacttgttcaactacaatagcaggagtaaggaatgtgtgattgagaaggtgataaaagaaaattaaaaccttcatctgctccttatttttcttaaattttcattactatttttttcttttctcacctttttcctgcactatgctctttatttctgaagctcagaggtcatttttctttcactcatttctacatgatttacttctgtatagagacatataatttgcttgcttgtttatatcaccagtggtttaaaaaataatttgaatttgccagcagagatacatgtaatgccaactgaggaatacagaacagaaggaaaagaatcacagaaaataatactatgcttccttggggaaaaagagaaaaaagtcaacttgaggaagaat

SEQ ID NO: 129757 - DNA, 4567 bp, Homo sapiens
  Payload ID: 5379
  Gene Symbol: ERO1B
  Gene Name: endoplasmic reticulum oxidoreductase beta
  Uniprot ID: Q86YB8
  ENST ID: ENST00000354619
  CDS Start-End: 203-1606
agtgggggcgctcgcctttcctgcctcactcgcagctgccgggtgttggggaaagagtcgcctgcctccggactggagtgcagacctctgaccctggagtcgctcggccgctgggaaccgtccccttgggtcgtcgcctgggccgcccgtcgttccccggccccgaggggtccggctggccgcggtgtgggtagaggtcagcatgagccaaggggtccgccgggcaggcgctgggcagggggtagcggccgcggtgcagctgctggtcaccctgagcttcctgcggagcgtcgtcgaggcgcaggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagattgtgagcaagctaataaactgggagcaattaacagcacattaagtaatcaaagcaaagaagctttcattgactgggcaagatatgatgattcacgggatcacttttgtgaacttgatgatgagagatctccagctgctcagtatgtagacctattgctgaacccagagcgttacactggctataaagggacctctgcatggagagtgtggaacagcatctatgaagagaactgtttcaagcctcgatctgtttatcgtcctttaaatcctctggcgcctagccgaggcgaagatgatggagaatcattctacacatggctagaaggtttgtgtctggagaaaagagtcttctataagcttatatcgggacttcatgctagcatcaatttacatctatgcgcaaattatcttttggaagaaacctggggtaagcccagttggggacctaatattaaagaattcaaacaccgctttgaccctgtggaaaccaagggagaaggtccaagaaggctcaagaatctttactttttatacttgattgagcttcgagctttgtcaaaggtggctccatattttgagcgctcaattgtcgatctttacactggaaatgcagaagaagatgctgacacaaaaactcttctactgaatatctttcaagatacaaagtcctttcccatgcactttgatgagaaatccatgtttgcaggtgacaaaaaaggggccaagtcactaaaggaggaattccgattacatttcaagaatatctcccgtataatggactgtgttggatgtgacaaatgcagattatggggaaaattacagactcagggtttaggaactgccctgaagatattattctctgaaaaagaaatccaaaagcttccagagaatagtccatctaaaggcttccaactcacccgacaggaaatagttgctcttttaaatgcttttggaaggctttctacaagtataagagacttacagaattttaaagtcttattacaacacagtaggtaataaaggcttttatgtgtctaactagagacataaagtgactgtggaaagccttttaattatggacattcatcagaaagacactaatctgacttcaagaattctgaactattaaatagaaaatttaaatgctcacttgaatatttatgattcttaatagattattatcaactagagatatttataaatgaagtatatacttttaaaacatgtaagttatactaattttgtgtttaatttcatatgttttcatgtaatgaaaattctattttttttagaattggttttgtttttattctattatcctttatttccagttgtcaaactttaaatggctatgtctgcattctaataacactgttcagtctgttatggaaaaggagaactagggaacaaatgttgctcagggctggtgtcagtgagaaaaatttatcaatgctttttaatgtgtttttacccttgcctcactgtgtgtgtgtcactttctataatataaagaaatactataatatttctagaatctggaactgtcaccatgatgaatggccctttcaatgcatagttacagaaattcctgaagattccccaggacttcaatttcattggtttttatttgcagtttttagttgctgtaattgttgctgtttccagtctaaaggacctcctttggtaaaggtgaacaagacctctcccctatgctacccagccagattttgtgtgtgtaatgggctggcccaagagtgttcttttacttagaactccttttgattttgcttttctctgcccctagaaattttagggacaaagacattttggaaattgtcagttacttttagaaagaaaacactgcagaaatatttaacagattacttcttgataaaatttaaatgggattatatgaatttataatgccaattgaaaatattatatacacaaaatttgctattttcacttaaagtaagcatttttaaaggatttattttagaatacaatctatgcaatcctcgaactcagtgtgcttttccctgacaggatatataaaaaggtagattaggtcaaccctcctttaagcttactctcccctcaccttttcttttcactgtatataaacggtactttctgtgattcataccaacagaggactttctgtgattcataccaacagtcctaaactgtcattttctaaatctgggatttaaaatctttagacaatatttaaaatcttgattttttttaaatgtcagcagatacaatttggaagattgcatctgtgtagaagtaatgcaggtacaagatctagagtttttccttagactctttagtcttttctgaattaaagaataagtgctcttaaatccatattttatcctgtcaaagtctgaaatgtgttcattgatgatttggtgacatctaaaaaattgtatttagttggcttggctcacccctcttaaaaatacttagccatctcttggtgggatgtggtgggggtattaaggtctcagagttatttattttctcacctaatttcaaacctttataaacttggggttttgttgttgatggtggtagtattttttgttaagttgtttaaaaggctgacttgattggagcctcctctactttttcttgagggttgcaagtattgtatggtgggggaggggggccttaaggcaaactgtctaaaaagtgactatccaattaatttaactagtaaattagtaagaattattcttagtattcactcagagtttaagatgtgaaaaatctgcactttgtttatcactctaaatgtaaagaactttttgatagtgttatttcaccactccctcagttaaaggctattatttaaactgtttactggagaaaatcctcgctcatgtccatttattgtttttttctgtactgtgatttgtttcaagcttaggaaaactagtatattagagtatgttctaggaaattaaaagatctggttagagtaaaaagttctttttaaggttcttaactaattttttcacaactaagaaaataaatgaagtattcttaggctgaaattcatcttattttatcataaattagattgtaggggcagcctacatttttgtgtatgtgtttttatttcttaaatgattgtgtgagcctggtgacattttatggttcttgtgatctaaactgtttttccaattcacatcttttgtcgtgaagtgatattatactagagtactgtttgcattgtaaaaatgctttgctggtgctctggcattttgtctttatctcatcacctaatttaaaaacccagcacttgataatataactgacagaaatgattgtacccactgatgaagtaatgaaaatgaagaaaaggaaaatattccttccttcaatggcgtaagtttattttttacttaagtggcatctatgtaagttagacaaactatatattaaaattggtaaactttgaatgtttctcctgttttgattcttagattatgaggaggatcagacagaataagactccacacttttgaaatttgataagtcaaaacgttttattttgacatttttaacattgtgaattattcgatatttgtaatctctgtatgtatatgaaactctgccatgtttttcaactttgcctatgtgccactgtatataagaaaggacagctattttgatcttcatcagcattgccttcagctgaaaatttgggaacagttcacagtaaacctctcagtagtttgcaaactgaggtacctgcagaaaccatagctactcaccaaaatacacagattaggtgcatggtatcgtggaaattatttggtaaaaaaacacacacacaaatctatgtgtactgtattttaaggaatatctacaggtgcagctttgattttgaacagaattccaaataatttactgttgtacccaccagaatctagaaaatgtgaattaaagtacatgtttctgcaa

SEQ ID NO: 129758 - DNA, 605 bp, Homo sapiens
  Payload ID: 5379
  Gene Symbol: ERO1B
  Gene Name: endoplasmic reticulum oxidoreductase beta
  ENST ID: ENST00000366589
  CDS Start-End: 391-605
ggagggccgggcagggccgggccagaaaagaggtgatttctggcgagcagaaaacccggggagcagagacctgaccgtccagtgcgggaaacatctgcgaaccgcccgcagggtggggggacggcgacactccgggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagattgtgagcaagctaataaactgggagcaattaacagcacattaagtaatcaaagcaaagaagctttcattgactgggcaagatatgatgattcacgggatcacttttgtgaacttgatgatgagagatctccagctgctcagtatgtagacctattgctgaacccagagcgttacactggctataa

SEQ ID NO: 129759 - DNA, 2096 bp, Homo sapiens
  Payload ID: 5380
  Gene Symbol: ERP27
  Gene Name: endoplasmic reticulum protein 27
  Uniprot ID: Q96DN0
  ENST ID: ENST00000266397
  CDS Start-End: 575-1396
gattacaggtatgagccaccacgcccggcctgtgctttagttctttacatgaaactccctttctaccttgtgttgcctggcaaaatcttacttacccagaactctgctccggcatcctccgcaggaagaacactttcattgaaccctagcattgtccctaatacccttaatatgtattgtcatagcaccctatgaatttttctatatcactttccatcttatatttaaataatctttttacttgcccatctctcccactgataatctaagctggcagaggctggatcagatcataattatctttctattcttagcgctaggatcaatgcctggcatagcatatttacattttttatttaaataaactgacctgactttcttctggttggatatgttctgagtccctattactaaccttggtcttttatctcagaagttgaaggctcccctggagccagctgcaaagttcccaaagccctaacaaccccacagccaatcagctacagagtaggctgccctgagtcggcctccccaacacaaagtccagggttggagcaggagcaggagagggacaatggaagctgccccgtccaggttcatgttcctcttatttctcctcacgtgtgagctggctgcagaagttgctgcagaagttgagaaatcctcagatggtcctggtgctgcccaggaacccacgtggctcacagatgtcccagctgccatggaattcattgctgccactgaggtggctgtcataggcttcttccaggatttagaaataccagcagtgcccatactccatagcatggtgcaaaaattcccaggcgtgtcatttgggatcagcactgattctgaggttctgacacactacaacatcactgggaacaccatctgcctctttcgcctggtagacaatgaacaactgaatttagaggacgaagacattgaaagcattgatgccaccaaattgagccgtttcattgagatcaacagcctccacatggtgacagagtacaaccctgtgactgtgattgggttattcaacagcgtaattcagattcatctcctcctgataatgaacaaggcctccccagagtatgaagagaacatgcacagataccagaaggcagccaagctcttccaggggaagattctctttattctggtggacagtggtatgaaagaaaatgggaaggtgatatcatttttcaaactaaaggagtctcaactgccagctttggcaatttaccagactctagatgacgagtgggatacactgcccacagcagaagtttccgtagagcatgtgcaaaacttttgtgatggattcctaagtggaaaattgttgaaagaaaatcgtgaatcagaaggaaagactccaaaggtggaactctgacttctccttggaactacatatggccaagtatctactttatgcaaagtaaaaaggcacaactcaaatctcagagacactaaacaacaggatcactaggcctgccaaccacacacacacgcacgtgcacacacgcacgcacgcgtgcacacacacacgcacacacacacacacacacagagcttcatttcctgtcttaaaatctcgttttctcttcttccttcttttaaatttcatatcctcactccctatccaatttccttcttatcgtgcattcatactctgtaagcccatctgtaacacacctagatcaaggctttaagagactcactgtgatgcctctatgaaagagaggcattcctagagaaagattgttccaatttgtcatttaatatcaagtttgtatactgcacatgacttacacacaacatagttcctgctcttttaaggttacctaagggttgaaactctaccttctttcataagcacatgtccgtctctgactcaggatcaaaaaccaaaggatggttttaaacacctttgtgaaattgtctttttgccagaagttaaaggctgtctccaagtccctgaactcagcagaaatagaccatgtgaaaactccatgcttggttagcatctccaactccctatgtaaatcaacaacctgcataataaataaaaggcaatcatgttataggagaaa

SEQ ID NO: 129760 - DNA, 993 bp, Homo sapiens
  Payload ID: 5380
  Gene Symbol: ERP27
  Gene Name: endoplasmic reticulum protein 27
  ENST ID: ENST00000540097
  CDS Start-End: 152-670
gcacagcgatgtgagctgaggtgcaggcaccagacctaggaattcctagaaaaatagtcaggaagcatttagacacatcaaatgttaaacgagtcctgattatgatgataatgatgatgattttggtggttgcaatagcaaagccttaagtatgaaggagacttgccagctggaaatacaggtagacaatgaacaactgaatttagaggacgaagacattgaaagcattgatgccaccaaattgagccgtttcattgagatcaacagcctccacatggtgacagagtacaaccctgtgactgtgattgggttattcaacagcgtaattcagattcatctcctcctgataatgaacaaggcctccccagagtatgaagagaacatgcacagataccagaaggcagccaagctcttccaggggaagattctctttattctggtggacagtggtatgaaagaaaatgggaaggtgatatcatttttcaaactaaaggagtctcaactgccagctttggcaatttaccagactctagatgacgagtgggatacactgcccacagcagaagtttccgtagagcatgtgcaaaacttttgtgatggattcctaagtggaaaattgttgaaagaaaatcgtgaatcagaaggaaagactccaaaggtggaactctgacttctccttggaactacatatggccaagtatctactttatgcaaagtaaaaaggcacaactcaaatctcagagacactaaacaacaggatcactaggcctgccaaccacacacacacgcacgtgcacacacgcacgcacgcgtgcacacacacacgcacacacacacacacacacagagcttcatttcctgtcttaaaatctcgttttctcttcttccttcttttaaatttcatatcctcactccctatccaatttccttcttatcgtgcattcatactctgtaagcccatctgtaacacacctagatcaaggctttaagaga

SEQ ID NO: 129761 - DNA, 1735 bp, Homo sapiens
  Payload ID: 5381
  Gene Symbol: ERP29
  Gene Name: endoplasmic reticulum protein 29
  Uniprot ID: P30040
  ENST ID: ENST00000261735
  CDS Start-End: 151-936
cgtggccccaccctctcaccctagacagatgggagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagtggacctgaagccattcttttttcttttcaaattatactttcgtctatgacctgctttcctctttgaatctaagctggtatagactccactttcccagggtaacaaactatcctcataacactgtggaaactggcatacctttgttattttccagtgatattcagactgacatggattgactgtcaatggtaaagtttgtctattttccagtccttaaaactcaatagcagtattgatgaatatattgaaccaacattgatggaccatggtgtaattattttccatgctttgtgaggtacacatagcaaattcttagttttactgatatattctgtgacttggatttacacagctaaatgatatagtccgatttcaaaattaaaaaatattttccatctaaatcactatcactaaataaatactaacttctagaaagcagaataaagagcacttgtgccaacatt

SEQ ID NO: 129762 - DNA, 1333 bp, Homo sapiens
  Payload ID: 5381
  Gene Symbol: ERP29
  Gene Name: endoplasmic reticulum protein 29
  Uniprot ID: P30040
  ENST ID: ENST00000455836
  CDS Start-End: 119-280
gagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagtggacctgaagccattcttttttcttttcaaattatactttcgtctatgacctgctttcctctttgaatctaagctggtatagactccactttcccagggtaacaaactatcctcataacactgtggaaactggcatacctttgttattttccagtgatattcagactgacatggattgactgtcaatggtaaagtttgtctattttccagtccttaaaactcaatagcagtat

SEQ ID NO: 129763 - DNA, 284 bp, Homo sapiens
  Payload ID: 5381
  Gene Symbol: ERP29
  Gene Name: endoplasmic reticulum protein 29
  ENST ID: ENST00000552052
  CDS Start-End: 1-284
gccccgcgccgcatttctctccccgctgcttccccttctcctgggcttcctgctcctctccgctccgcatggcggcagcggcctgcacaccaagggcgcccttcccctggatacggtcactttctacaaggggccccttgggaaggggaattagccccaaaagtccctggaacacccacttgctcagctctatacgccctcaggtcattcccaaaagcaagttcgtcttggtgaagttcgacacccagtacccctacggtgagaagcaggatgagttcaagcgt

SEQ ID NO: 129764 - DNA, 1698 bp, Homo sapiens
  Payload ID: 5381
  Gene Symbol: ERP29
  Gene Name: endoplasmic reticulum protein 29
  ENST ID: ENST00000546477
  CDS Start-End: 700-1182
tacagtgtaatatttatttggccataaaaagtaacagtgtgccaatacatggtacaacatggacaaaccttgaaaacatgctaagtgaaaaaagccagacacaaaagggcacatattgtacatttccatcagaatagacaaatctatagagacagaaaatagatgagtggttgctggggctgggaggaggaagactggggagtgactgcgtaatgagtatagggtttccttttgggatgatgaaaatgttctggcactagatagtaacctctatggttgcacattcttaatgcactgaatcatgcagaatgtacacttttaaatggttacaatggcaaatattatgtgaattttactgcaattaaaagtcttggccctgacagtttaaaacccagagatctagccagagggaagtgtagtctagggagaagacattgtcccaagcctggcctctcactagcttatctgccctgaaattgctgggttcaaactctggcctatctagccaaagcgtcctccatgatgccaactcctttgtaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagtggacctgaagccattcttttttcttttcaaattatactttcgtctatgacctgctttcctctttgaatctaagctggtatagactccactttcccagggtaacaaactatcctcataacactgtggaaactggcatacctttgttattttccagtgatattcagactgacatggattgact

SEQ ID NO: 129765 - DNA, 4854 bp, Homo sapiens
  Payload ID: 5382
  Gene Symbol: ERP44
  Gene Name: endoplasmic reticulum protein 44
  Uniprot ID: Q9BS26
  ENST ID: ENST00000262455
  CDS Start-End: 201-1421
gaagtgagggtgtgagaggcctctctggaagttgtcccgggtgttcgccgctggagcccgggtcgagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctcagatgctcccttctgctcctggtaacttgggtttttactcctgtaacaactgaaataacaagtcttgatacagagaatatagatgaaattttaaacaatgctgatgttgctttagtaaatttttatgctgactggtgtcgtttcagtcagatgttgcatccaatttttgaggaagcttccgatgtcattaaggaagaatttccaaatgaaaatcaagtagtgtttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattacatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttgggagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattttgggtttttaatttttttctccccgactcaaaatgcattgtcatttaatatagtagcctcttaaaaaaaaaaaacctgctaggatttaaaaataaaaatcagaggcctatctccactttaaatctgtcctgtaaaagttttataaatcaaatgaaaggtgacattgccagaaacttaccattaacttgcactactagggtagggaggacttagggatgtttcctgtgtcgtatgtgcttttctttctttcatatgatcaattctgttggtattttcagtatctcatttctcaaagctaaagagatatacattctggatacttgggaggggaataaattaaagttttcacactgtgtactgtgttttactgattggttggatattgcttatgaaaattccatagtggtatttttttggattcttaatgtgtaacttaaacatactttgaagtggaggagagtcataagacagaacatttggcaggaattgtccttatgaaacaagaaaaagaaaatgaaaagtattattaagcttctgtgtttgtctaaaaatgtggcatatggatggcatttaaaactttgaatgaattatacctaaatctgggacagggaggtgacagtggaacaggctaccaatcagaactagatgacttttaaggctcctcctattatgagacttcaatttccaaagagaagaactagcagagaaattgtatttcagtaattttaagctccttctgtcttgtagagtcttgttatagttgtataaatcaaaaacacagaataaggaacatatttaactttttttcattataaaatggttagaggaccctaccccctctagattccctgatttccccaggcctgcagcatacagtaagatgggtccctgtgccaggcctcaatactgccagggaataaaaccagagggagaggaccctcagtgtcatatcaggaagcccagtgccagaggacagacaggttcaaaactggcttttcctctgggcctgggttggtgctataggccaagggtcattttatacttgggtataaatcaatcccagtttgggaaaagattatttttaagcttaaaaggctgacatgtgccattatatgtagtatgtaatatatgtaacatcttccaattcttttaaaataaaattaatatttataatggatatttaatgattgttatttttaaaaaccagcttataattcctcgttatgcatgatttatccaaagtttccatagttttattcaaaataataaatgttaataaggtgataaggggtatatttaatgtattgtatcaaattgtgaataagaaagtaggatggagctttctagaggttgggccttagttctgttatcctcattgcttttaaccaataagttaaatgaagttagagttatggtcttcaggttagattatggaccagatctgtgagggtcagcatggaaattcacattcaacaaggtagcacacaggaccaagagcagcacatgcaatcaactggaataatatagtaatcctgtaactgggtttgaaaaaataatcaacaaaagatacaattcaagggttaggttgcagagagctggcttgagagtagttattatgaaaaaggcctcaaggagtacgtgttcagtatgctctaagatgataaagtggctgttaaaaagggagttgatttgaggaagtattacttagcattcatgcatattgggcttaggctctagccctgccactatcattgtcttctctggactgtgaagtcactgaggacaaggaaactaaatttaatgtctgtatcactagtgcctagaatttctggacacttagtagtcaccatcaggcgtttatttaatgaatgagaagcaaagtgaccttggttacttttttaccctgaggggctcagcactcattaggacttggtgcctaattttataaaaagtcactaagctcaagtgcttggatgaaaggacagcgtggataaaaaggtttttaaaacatggatgttaaggctgttttgcttggagaagacttgggactgggacagtctttagatattatttgaaatgctggcactgtctatctggatcccagggcttgaactaggatttgaggaagtcacagggaagcagatttcagtctgacatttattcagtgcaagttttttggtgctgtagtatatgatgaaagatgtaaagctgaataaagcattatttctgccctagagttgttcacagcctagtcaggcatatggatatgtaaacaatgactgtaacgtgttatagatgtaaagacaaaataaaggttaaagagggcataaaggagcactcaattgcagagatttgaggacattatttttattttgagctttaaaaagatgaataggtgttctcaggaggtagggatctggctgagagggaataatctgagcaaaggtatgaaacagcctaatgcattagagaaaaaagttcttttagtaaggcatttggggttggggaagctagaaaaagaaatgggagctggtcacacagggccttgtgtgccagactaaggggtttgtagtatatattgtaggcagaagagatccatcaacagattgcaagcaaggaagtatgttcactttaaagtttgagaaagaatagtgtggaagcacgtctcaaatttagacttgttccccctctgaaccgtgaatcagaccatttcaggtagaagtcttccccggtttatctgatctactcggggcctcaggcttctcagctgggaagagaggatgcaagaccagactgaagaacacggttgagtccccagaaccaaaagggggcctttctgcttcttagccagctacctcttcgagtttttcaaattgtgagggggaccataaaaggatggaaacttttagatgacattctacaaattatttttttctttaaattaaaagaacctagccaataagatagagaatgggcatctaaggcatctcagagctctctgatgaagccaggttgtcaaagatcatttgcaaaagaagggaaaactggcatgacaaaagctacagagaggagagtgaaatatagaagtgtttgaaatgttcaagctcacaataagcttaaatttatagaaaatgctaaggttgtcaagaaggcttttttttttttcttttttaaacctgagggcaaaaaggaatggataaagtagtgtaatggattgacaatcaggaagaacagaataactcagttttttttctcctacaaggagatatggctggaccaaaataaaatgacatgaaactgcaaaaatgaaaa

SEQ ID NO: 129766 - DNA, 7876 bp, Homo sapiens
  Payload ID: 5383
  Gene Symbol: ERN1
  Gene Name: endoplasmic reticulum to nucleus signaling 1
  Uniprot ID: O75460
  ENST ID: ENST00000433197
  CDS Start-End: 97-3030
gtccgctgaggctcggtcaccgcctcgctgtcgtcgcggcgcccccgccccgtcctctgtccgtaccgcccccggagccagggccgagtcctcgccatgccggcccggcggctgctgctgctgctgacgctgctgctgcccggcctcgggatttttggaagtaccagcacagtgacgcttcctgaaaccttgttgtttgtgtcaacgctggatggaagtttgcatgctgtcagcaagaggacaggctcaatcaaatggactttaaaagaagatccagtcctgcaggtcccaacacatgtggaagagcctgcctttctcccagatcctaatgatggcagcctgtatacgcttggaagcaagaataatgaaggcctgacgaaacttccttttaccatcccagaattggtgcaggcatccccatgccgaagttcagatggaatcctctacatgggtaaaaagcaggacatctggtatgttattgacctcctgaccggagagaagcagcagactttgtcatcggcctttgcagatagtctctgcccatcaacctctcttctgtatcttgggcgaacagaatacaccatcaccatgtacgacaccaaaacccgagagctccggtggaatgccacctactttgactatgcggcctcactgcctgaggacgacgtggactacaagatgtcccactttgtgtccaatggtgatgggctggtggtgactgtggacagtgaatctggggacgtcctgtggatccaaaactacgcctcccctgtggtggccttttatgtctggcagcgggagggtctgaggaaggtgatgcacatcaatgtcgctgtggagaccctgcgctatctgaccttcatgtctggggaggtggggcgcatcacaaagtggaagtacccgttccccaaggagacagaggccaagagcaagctgacgcccactctgtatgttgggaaatactctaccagcctctatgcctctccctcaatggtacacgagggggttgctgtcgtgccccgcggcagcacacttcctttgctggaagggccccagactgatggcgtcaccattggggacaagggggagtgtgtgatcacgcccagcacggacgtcaagtttgatcccggactcaaaagcaagaacaagctcaactacttgaggaattactggcttctgataggacaccatgaaaccccactgtctgcgtctaccaagatgctggagagatttcccaacaatctacccaaacatcgggaaaatgtgattcctgctgattcagagaaaaagagctttgaggaagttatcaacctggttgaccagacttcagaaaacgcacctaccaccgtgtctcgggatgtggaggagaagcccgcccatgcccctgcccggcccgaggcccccgtggactccatgcttaaggacatggctaccatcatcctgagcaccttcctgctgattggctgggtggccttcatcatcacctatcccctgagcatgcatcagcagcagcagctccagcaccagcagttccagaaggaactggagaagatccagctcctgcagcagcagcagcagcagctgcccttccacccacctggagacacggctcaggacggcgagctcctggacacgtctggcccgtactcagagagctcgggcaccagcagccccagcacgtcccccagggcctccaaccactcgctctgctccggcagctctgcctccaaggctggcagcagcccctccctggaacaagacgatggagatgaggaaaccagcgtggtgatagttgggaaaatttccttctgtcccaaggatgtcctgggccatggagctgagggcacaattgtgtaccggggcatgtttgacaaccgcgacgtggccgtgaagaggatcctccccgagtgttttagcttcgcagaccgtgaggtccagctgttgcgagaatcggatgagcacccgaacgtgatccgctacttctgcacggagaaggaccggcaattccagtacattgccatcgagctgtgtgcagccaccctgcaagagtatgtggagcagaaggactttgcgcatctcggcctggagcccatcaccttgctgcagcagaccacctcgggcctggcccacctccactccctcaacatcgttcacagagacctaaagccacacaacatcctcatatccatgcccaatgcacacggcaagatcaaggccatgatctccgactttggcctctgcaagaagctggcagtgggcagacacagtttcagccgccgatctggggtgcctggcacagaaggctggatcgctccagagatgctgagcgaagactgtaaggagaaccctacctacacggtggacatcttttctgcaggctgcgtcttttactacgtaatctctgagggcagccacccttttggcaagtccctgcagcggcaggccaacatcctcctgggtgcctgcagccttgactgcttgcacccagagaagcacgaagacgtcattgcacgtgaattgatagagaagatgattgcgatggatcctcagaaacgcccctcagcgaagcatgtgctcaaacacccgttcttctggagcctagagaagcagctccagttcttccaggacgtgagcgacagaatagaaaaggaatccctggatggcccgatcgtgaagcagttagagagaggcgggagagccgtggtgaagatggactggcgggagaacatcactgtccccctccagacagacctgcgtaaattcaggacctataaaggtggttctgtcagagatctcctccgagccatgagaaataagaagcaccactaccgggagctgcctgcagaggtgcgggagacgctggggtccctccccgacgacttcgtgtgctacttcacatctcgcttcccccacctcctcgcacacacctaccgggccatggagctgtgcagccacgagagactcttccagccctactacttccacgagcccccagagccccagcccccagtgactccagacgccctctgagcgagggcggcccctctgttctggtggccccagctgtgactgagggcctggtcaccacaattagagcttgatgcctcccggctttgcagggagaccaggcttcccaaaccaagtgccttgagctgcctgctctgcagcccacagaggacagtgctgaccccaggaagtgggagaagtggcccctcgtgacctacagggaactgggaagatgctggccccaaaagccttacggtcatgatgtctgcaaaggagggcctcagagacagcgcgagtagcacccccagccatctactggataaacttgcttcagactttttaaattcctgcttaatgtcagtctacaggcctttcaggaagggagaggagggaatcgtacattttgcttgcgtgctgggacagctaggctgagatgcaccaagtacagccttcactggagaccggaattgagaggtgggggatgctgaggagggggaggacggagttcagagggtgtcgtcctgcagtgtgagatttctcattgatcacagatgtgcccagagtagcccaggtcactgttaactagtgtttctgcagaggcagcaggagccatgagcatgaggtgtggcattagggactggtcagctatgcatgctggcaggtggggttgtgtctgcaggtctcagaaatgaagaggctgctctgttctggaggcagccgtggcccagtgccagtggccagaacagtggcctttggtgggtgtgtcccgggccatctcggggtggtgctcaggagcgcctggggcaagaggtaaagagttccctggccttcaaggagagcagcgaagacccagacaggggccagccttcaggaccagagggaggccgccgaatgggaccctcctggtcaccaggagaaagccctgggccagcgagtaggcagtcaaactccttcgtccccaaggccggtggaacaagaggctcgtggtgagtcagggccagggtgggtggccaaggccagggtcaccgtgtgcttcatgggccagcttttttgtttttcttggcaaattttaataactatattttgattatactgtagaatgctatgtcagcataagtaagctaaacttgaagctttcttgtgaagaataaatgcaagatagaatacatcttctattttttgtggtaccaaaaatcaccatcccctcaagagtgttcatgtatagaacattctctaatgctgaagagtaaaacattatagcaacactatgtaaatgtattgaacagtatcaaagaaatagtctctaaattgtttgtaccatatttttttttctaaacttaacataatttttagctttagtttcagtcaaaactttgtcttttctctcccgagagccttagaggttaaaatgcaatcagcctaccgtgtaaggagatgttgtccatgtactttctccagccagttgggggatcattgcagctcaggcctggtgaactcagagattccattcagtattaagaatgggattgttgaattttactcacagagaaatcactgtttcttcatgttgtaagatgttttctgtttgtgtatttgtatcatggttactcatcaaaagctctcattctgcctttgtagaattcagttcccttcctttcatcatagctaaagtgacttttttccctactattaacgtgatcctacatccttaaatctcatcgattacctcacttaggccttggaaccttggcccttggtcggtgtccttggcgtcttctaagcaaggctgtgcgttgttcagaaacgtggccagaccgcatttcctgctgctcccatgccgcatgccaggtggcctgagacagagctccccatacggctgcaaggtgctttacctgtgggctttggcagtaacccaagagaggatcagaaggtggagaaggtgccacgagtgatttaacaggcctgccacagggagtgcccccagcccagctcgttctcagcacaggttttctctttgggagtacccaggtgatttctagtgacccaattttgtgtcatctccctgttttagccccacttgcctagagacaactgtttccgatgccttttctgcttatcatactagtttctaaccacgcagatttctcaaaatcatttattcaatgtattttatttgagcacttagtgtattgagctaggcaggatatagggtgccggagatacagcgatgaacaagacaggcaaaacttctgctttcctaaaacttgtgatgagagagaacaataaaaaagtgttgctgccacaaagaaaccaaagtgtgtggggaagggcgcgtgtttgcggtttacatctcttctgtcccagaatcacagggatctggtccggtcacctctggtctttcctcttagtcgcctttaggagccctggttcccgtccatcctctggggggtttgtttgaagagatctcgtgtgggtacttgtcatgaaaacaccttgggcatcatctggtgtatccagttctagtctcgagaattctggtttcccactgtgctcagcaagtggaaagttcttttcaggccagaacagctctgcaccatcacatatcgtgttgcggcttagctgtttggtctgtagttcaggttatgggacttctccaatcctggaaggctgttgagctttttagaagtactgtacgctatcttcaagatggagcttggtcacatctgttaggaatccaaaggacactatgacttatttaaatcttgtcttactaaacctctcttgggcacgtgtgccagaatttctcttgttgcttcttgagtctttttaatttcagtgttttttcgtttgttttttgtttttttgagacagagtctcgctctgtcacccaggctggagtgcagtggcacgacctcagctcactgcaacctccgcctccttggttcaagcaattctcctgcctcagcctcccgagtagctgggattacaggtgtgtgccaccacgctcggctaattttttatattttttttagtagagacggggtttccccatgttaggcaggatggtctcgatctcctaacctcgtgatccgcctgcctcagcctcccaaagtgctgggattacaggcttgagccaccgcacccggcctaatctcagtttttgaagtgctccacaagtcattaggcaccaaaacattttcacctggggaacactggcatttccctgattagctgtgaagcaatctagtggctaagtgtgaaatcctgggtgcgcaggtgttctcactcccgccgtgttctcagtgcagtggtggtcagaggcccttccaaggagacatcactctgatcagttacagatagatgttctggaagatctgcaggtgagtagatccagcagagtttcttcccaccaactctagaagaaagggccttatcagagttgaccctgagcctttggtaaggttttgtgtgcatgcgattcagttatctttggcaattcttttcttgctgcagtgagagattaattggttgctgatcaaaccgttcatgcagatggggggacctttggattgtacggctttctcctcttggctgctttcttttcaggaagttggactttggccaggtttggctttcccagagccgttcctttctctgtcctttccttgggtcctcatggtgtgcccattggatccttggccttgtgatcctctgggaactgggggccagttccacttttgcagccttctgtgctggaagagaagcccagcgccctggaaggagcctctttaagtcccccatgtcgctttctctctctgctcttttagtgtctgagattgcctttctttgaatttcccagtgtttcttttccttgtcccttccctcaccaacctggagttattttggttgactatgtcctggctttggcttctcctggcaggaagtcatcaggcatcctctccaggtgagccgaaattccaccctcccaggttggacatcatcttttaaacccaatggtctactcccctccttctttatgaaacagtgatttcccgtgagtaactctggttctgattttttgtaccggcgcttaaattctttctgtagacgttggaaagccacaaagaacgtgactgcagtgagcctcccactggagcagccttaaccaacactttggccaaagcccccccacctcccctgtgtactgtgtgtgtgtttggtggatacagtattccttttcagtgtccctaaagctgtgatggggagtccccacttacctagaaagcattaccagtcacctactctgcattctcagatgtaaaccttgtgtagtgttctttttgcaatgacctatttatttaacctatttatatttatttaatttttactctgaaatgtatccagttacaattgtacttgcttaaagcacatcagatttgttttggacaacacccttgaccattttaaaactggaaaagtgatactgtatccttccatgggatggatgctttacagtagtcttattattaaagggtgattaatttggtcggggtaaaatgttaatttttaggtgatttttaagaattctgtgccattatgtcttctgtgtggatggttaattgtttaattagtacgtgttaattgtgtgatacagtcttctttgtggaacccaaaatcctctttttagctttatattttataaactgccagattgtacaacttttatgtgcatttttaaagcttgaagacatgagggtcattatctaagttaaacagcctatttttgtgcctcctgtacagttttataattctgctgatggcggcatcttatgtcgagccaaccacaataaaggtagttttagattttgga

SEQ ID NO: 129767 - DNA, 2068 bp, Homo sapiens
  Payload ID: 5383
  Gene Symbol: ERN1
  Gene Name: endoplasmic reticulum to nucleus signaling 1
  Uniprot ID: O75460
  ENST ID: ENST00000606895
  CDS Start-End: 791-1003
gttcattccaagcggaagtgatggctggtggatatgacttgaggggaattcctgagggcaaggaaaaggaagaaaggggccccagagaagacgaggcacagctggagaaccctagggctgtgaacactgcgactgccgcgcggggcagctgcgccgtgtttgctggaagcctccggtagctgctgaaaccttcgctccggaggtcgcctcggtaaaccttgcggatgattccaccacggcggaaagacgaaaaggaggcttctaggcacccgggaccgcccgtgtcccgcccttttccccgatgaagtctgacgcggcaggtccctcggcagggttaatgggacggcctggtggggcattgccggtctttcccagccacagacaagcttcgcgcctcgatcccccagcgcccccagacgctggatgccgaggcctggtcctttacagccgccgacgcctcatgagcgaagccagccagatgccagcaccgccttcggccccgccccgagccagcccctcccacatccccgcccggggcacgccctcggcccgcccccatctccgccccgaacacgcccctagattggccccgccccgtccccgcccgcaactccgccccgaccggaagaagccgcggcacccagcgcttatagggccgggaatgggggtgccgccgctgcctagtcagttctgcgtccgctgaggctcggtcaccgcctcgctgtcgtcgcggcgcccccgccccgtcctctgtccgtaccgcccccggagccagggccgagtcctcgccatgccggcccggcggctgctgctgctgctgacgctgctgctgcccggcctcggggtgagtgaccggggagcgtggggtggaggacagctcgcgacggccgggtcggggccggggcagcgtcgcggcgccggggctggagtccgagctgggagcgcgacggcggcggccagatgccccgtgagcccagccgtgggaggctcgggccgggcgtaggaggcggcaccgggccgggagagcttccctgacgggagtcgcggccccaccgaggcgtcggccgcccgaagagcctcccaagccagcgcggctgtcacgggcagcggctccccggaccccgcgggctcgggcgcaacttcgtggcgtcctgcacggcacttgggggtcccagaaggccccggcctgaggaggccgcccacctgcgggaccctcctcctcgcgggcgggcgccggcgctgcctggcgggggccgcggaggagccgaaagggcgttgggatccaggggaagggtctgtcctgcgcttcgaatccttgtttgaactttttaaaaattcgaaaactttggggaacgaatgcaacagggagtaaggactctcacccgagagctggcttctgccacttgccctgccggtttcttggtactgggaggctgcaggcttccttctgtgcaccgagacttccttgagcaagtggagctgtgggaattgcactcttggaagatcccgcatgggttcgaggtgaggccgcttcagaacctcaaatgaaagactgtctcctcgtgggagagcacctggggccatcagaaatgtcttttcatctttttctggaggagacgaatgatagggcctggtttacattcatttaactctttatgaccttcactcagctgtggatttgggggcactttgtgggagacttggcttttttttttcttctggttggaagaacctaaattagcgaatgtttttcacaaaatgtattgttcaggatgtgagcgtggcaaatttgtccgtgttctgtttaatgacctctttaaaggtactgtgtactctttaatagggatatcatgtaccaggtgtcccagtagagcactgacatgtgtgtgcctgagtgccagccaccgtgtgaactctttggaggttttgcattttaggtaaataactgtctgtactcttggagtaacaagaatttggaaacaggagaagtaaataaataaggttgcctttttcaaattcagggtttttttttttaaataaaggaaaatttgtagactctttataatag

SEQ ID NO: 129768 - DNA, 3549 bp, Homo sapiens
  Payload ID: 5384
  Gene Symbol: ERN2
  Gene Name: endoplasmic reticulum to nucleus signaling 2
  Uniprot ID: Q76MJ5
  ENST ID: ENST00000256797
  CDS Start-End: 314-3094
gcttgtacctgctgtgcagtgaggactccaggaactgatgatgaaccggcacggtcctcggcacgtggcaagttctccataagtgggctcagtaaaatccctctcccgggaaagcgccccaccgtgtttggtggggtgactgggacgcgaggatgcggctgggagtgtgatgagaagggcggggatcggcgaggactccaggctggggttgcaggcccagccaggggcggagccttctccgggtcgggcggggacagagcgctcccttggaggcacccagggacctggccagccgtgcagctgcccaggcgctatggcgagtgcggtcagggggtcgaggccgtggccccggctggggctccagctccagttcgcggcgctgctgctcgggacgctgagtccacaggttcatactctcaggccagagaacctcctgctggtgtccaccttggatggaagtctccacgcactaagcaagcagacaggggacctgaagtggactctgagggatgatcccgtcatcgaaggaccaatgtacgtcacagaaatggcctttctctctgacccagcagatggcagcctgtacatcttggggacccaaaaacaacagggattaatgaaactgccattcaccatccctgagctggttcatgcctctccctgccgcagctctgatggggtcttctacacaggccggaagcaggatgcctggtttgtggtggaccctgagtcaggggagacccagatgacactgaccacagagggtccctccaccccccgcctctacattggccgaacacagtatacggtcaccatgcatgacccaagagccccagccctgcgctggaacaccacctaccgccgctactcagcgccccccatggatggctcacctgggaaatacatgagccacctggcgtcctgcgggatgggcctgctgctcactgtggacccaggaagcgggacggtgctgtggacacaggacctgggcgtgcctgtgatgggcgtctacacctggcaccaggacggcctgcgccagctgccgcatctcacgctggctcgagacactctgcatttcctcgccctccgctggggccacatccgactgcctgcctcaggcccccgggacacagccaccctcttctctaccttggacacccagctgctaatgacgctgtatgtggggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcagcaacagccgcaggtggtggagaagcagcaggagacccccctggcacctgcagactttgctcacatctcccaggatgcccagtccctgcactcgggggccagccggaggagccagaagaggcttcagagtccctcaaagcaagcccagccactcgacgaccctgaagctgagcaactcaccgtagtggggaagatttccttcaatcccaaggacgtgctgggccgcggggcaggcgggactttcgttttccggggacagtttgagggacgggcagtggctgtcaagcggctcctccgcgagtgctttggcctggttcggcgggaagttcaactgctgcaggagtctgacaggcaccccaacgtgctccgctacttctgcaccgagcggggaccccagttccactacattgccctggagctctgccgggcctccttgcaggagtacgtagaaaacccggacctggatcgcgggggtctggagcccgaggtcgtgctgcagcagctgatgtctggcctggcccacctgcactctttacacatagtgcaccgggacctgaagccaggaaatattctcatcaccgggcctgacagccagggcctgggcagagtggtgctctcagacttcggcctctgcaagaagctgcctgctggccgctgtagcttcagcctccactccggcatccccggcacggaaggctggatggcgcccgagcttctgcagctcctgccaccagacagtcctaccagcgctgtggacatcttctctgcaggctgcgtgttctactacgtgctttctggtggcagccacccctttggagacagtctttatcgccaggcaaacatcctcacaggggctccctgtctggctcacctggaggaagaggtccacgacaaggtggttgcccgggacctggttggagccatgttgagcccactgccgcagccacgcccctctgccccccaggtgctggcccaccccttcttttggagcagagccaagcaactccagttcttccaggacgtcagtgactggctggagaaggagtccgagcaggagcccctggtgagggcactggaggcgggaggctgcgcagtggtccgggacaactggcacgagcacatctccatgccgctgcagacagatctgagaaagttccggtcctataaggggacatcagtgcgagacctgctccgtgctgtgaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccgccagactcagaggccaggaggccatgccctggggccacagggaggtgaggtgggctggatgccacacagatggtctccgtgctggctcactgaagagctgagcctgtggctggcctcagaatcaggctgggtgcagtggctcacacctgtaatcccagcattttgggaggctgagtgagaggatcacttgagctcaggagttcgagaccagcctggccaacatggcaacaccccatttctacaaaaaatttgtaaaattagccaggcatggtggcgcacgcctgtagtcccagctgcttgggaggctgaggtgggagaatcacttgagcccaggagttcgaggctgcagtgagccaggatcatgccactgcactccagcctggtccacagagagacactgtcaccccctttcccccacaagactggcagaggctgggcagcctggggctgatgaagcagagatgttcgctggatcccaggccctggcacccctcaggaaatac

SEQ ID NO: 129769 - DNA, 3169 bp, Homo sapiens
  Payload ID: 5384
  Gene Symbol: ERN2
  Gene Name: endoplasmic reticulum to nucleus signaling 2
  ENST ID: ENST00000457008
  CDS Start-End: 40-2664
acccagggacctggccagccgtgcagctgcccaggcgctatggcgagtgcggtcagggggtcgaggccgtggccccggctggggctccagctccagttcgcggcgctgctgctcgggacgctgagtccacaggttcatactctcaggccagagaacctcctgctggtgtccaccttggatggaagtctccacgcactaagcaagcagacaggggacctgaagtggactctgagggatgatcccgtcatcgaaggaccaatgtacgtcacagaaatggcctttctctctgacccagcagatggcagcctgtacatcttggggacccaaaaacaacagggattaatgaaactgccattcaccatccctgagctggttcatgcctctccctgccgcagctctgatggggtcttctacacaggccggaagcaggatgcctggtttgtggtggaccctgagtcaggggagacccagatgacactgaccacagagggtccctccaccccccgcctctacattggccgaacacagtatacggtcaccatgcatgacccaagagccccagccctgcgctggaacaccacctaccgccgctactcagcgccccccatggatggctcacctgggaaatacatgagccacctggcgtcctgcgggatgggcctgctgctcactgtggacccaggaagcgggacggtgctgtggacacaggacctgggcgtgcctgtgatgggcgtctacacctggcaccaggacggcctgcgccagctgccgcatctcacgctggctcgagacactctgcatttcctcgccctccgctggggccacatccgactgcctgcctcaggcccccgggacacagccaccctcttctctaccttggacacccagctgctaatgacgctgtatgtggggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagcaacagccgcaggtggtggagaagcagcaggagacccccctggcacctgcagactttgctcacatctcccaggatgcccagtccctgcactcgggggccagccggaggagccagaagaggcttcagagtccctcaaagcaagcccagccactcgacgaccctgaagctgagcaactcaccgtagtggggaagatttccttcaatcccaaggacgtgctgggccgcggggcaggcgggactttcgttttccggggacagtttgagggacgggcagtggctgtcaagcggctcctccgcgagtgctttggcctggttcggcgggaagttcaactgctgcaggagtctgacaggcaccccaacgtgctccgctacttctgcaccgagcggggaccccagttccactacattgccctggagctctgccgggcctccttgcaggagtacgtagaaaacccggacctggatcgcgggggtctggagcccgaggtcgtgctgcagcagctgatgtctggcctggcccacctgcactctttacacatagtgcaccgggacctgaagccaggaaatattctcatcaccgggcctgacagccagggcctgggcagagtggtgctctcagacttcggcctctgcaagaagctgcctgctggccgctgtagcttcagcctccactccggcatccccggcacggaaggctggatggcgcccgagcttctgcagctcctgccaccagacagtcctaccagcgctgtggacatcttctctgcaggctgcgtgttctactacgtgctttctggtggcagccacccctttggagacagtctttatcgccaggcaaacatcctcacaggggctccctgtctggctcacctggaggaagaggtccacgacaaggtggttgcccgggacctggttggagccatgttgagcccactgccgcagccacgcccctctgccccccaggtgctggcccaccccttcttttggagcagagccaagcaactccagttcttccaggacgtcagtgactggctggagaaggagtccgagcaggagcccctggtgagggcactggaggcgggaggctgcgcagtggtccgggacaactggcacgagcacatctccatgccgctgcagacagatctgagaaagttccggtcctataaggggacatcagtgcgagacctgctccgtgctgtgaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccgccagactcagaggccaggaggccatgccctggggccacagggaggtgaggtgggctggatgccacacagatggtctccgtgctggctcactgaagagctgagcctgtggctggcctcagaatcaggctgggtgcagtggctcacacctgtaatcccagcattttgggaggctgagtgagaggatcacttgagctcaggagttcgagaccagcctggccaacatggcaacaccccatttctacaaaaaatttgtaaaattagccaggcatggtggcgcacgcctgtagtcccagctgcttgggaggctgaggtgggagaatcacttgagcccaggagttcgaggctgcagtgagccaggatcatgccactgcactccagcctggtccacagagagacactgtcaccccctttcccccacaagactggcagaggctgggcagcctggggctgatgaagcagagatgttcgctggatcccaggccctggcacccctcaggaaatacaagaaaaagaatattcacatctgtttaatgtgcataaagccaaggaaagg

SEQ ID NO: 129770 - DNA, 759 bp, Homo sapiens
  Payload ID: 5384
  Gene Symbol: ERN2
  Gene Name: endoplasmic reticulum to nucleus signaling 2
  ENST ID: ENST00000562458
  CDS Start-End: 1-72
gagcttctgcagctcctgccaccagacagtcctacaaggtggttgcccgggacctggttggagccatgttgagcccactgccgcagccacgcccctctgccccccaggtgctggcccaccccttcttttggagcagagccaagcaactccagttcttccaggacgtcagtgactggctggagaaggagtccgagcaggagcccctggtgagggcactggaggcgggaggctgcgcagtggtccgggacaactggcacgagcacatctccatgccgctgcagacagatctgagaaagttccggtcctataaggggacatcagtgcgagacctgctccgtgctgtgaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccgccagactcagaggccaggaggccatgccctggggccacagggaggtgaggtgggctggatgccacacagatggtctccgtgctggctcactgaagagctgagcctgtggctggcctcagaatcaggctgggtgcagtggctcacacctgtaatcccagcattttgggaggctgagtgagaggatcacttgagctcaggagttcgagaccagcctggccaacatggcaacaccccatttcta

SEQ ID NO: 129771 - DNA, 2263 bp, Homo sapiens
  Payload ID: 5384
  Gene Symbol: ERN2
  Gene Name: endoplasmic reticulum to nucleus signaling 2
  ENST ID: ENST00000562562
  CDS Start-End: 36-425
agggacctggccagccgtgcagctgcccaggcgctatggcgagtgcggtcagggggtcgaggccgtggccccggctggggctccagctccagttcgcggcgctgctgctcgggacgctgagtccacaggttcatactctcaggccagagaacctcctgctggtgtccaccttggatggaagtctccacgcactaagcaagcagacaggggacctgaagtggactctgagggatgatcccgtcatcgaaggaccaatgtacgtcacagaaatggcctttctctctgacccagcagatggcagcctgtacatcttggggacccaaaaacaacagggattaatggctggagtgcagtggtacgatcacaaggctcactgcagcctcgaactcctggcctcaagcaatcctcgcacctcagtatcctgagtagctggaactacagaaactgccattcaccatccctgagctggttcatgcctctccctgccgcagctctgatggggtcttctacacaggccggaagcaggatgcctggtttgtggtggaccctgagtcaggggagacccagatgacactgaccacagagggtccctccaccccccgcctctacattggccgaacacagtatacggtcaccatgcatgacccaagagccccagccctgcgctggaacaccacctaccgccgctactcagcgccccccatggatggctcacctgggaaatacatgagccacctggcgtcctgcgggatgggcctgctgctcactgtggacccaggaagcgggacggtgctgtggacacaggacctgggcgtgcctgtgatgggcgtctacacctggcaccaggacggcctgcgccagctgccgcatctcacgctggctcgagacactctgcatttcctcgccctccgctggggccacatccgactgcctgcctcaggcccccgggacacagccaccctcttctctaccttggacacccagctgctaatgacgctgtatgtggggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcaggtaggcccaccgccctgacctcaggtctatctggggagaacgctgcttctcctctctgagaccactcagcaactctctccctctacccagctctgattttgccccctgcctccctcccagcagctccccaggcccctgcgatcttgctctgtaagttcatgcagtctggtgaggccatctcagtcacagatactgggcccatcacggggcagggcgtggccaggacaaagctctcttaggctctcatgttacagcaacagccgcaggtggtggagaagcagcaggagacccccctggcacctgcagactttgctcacatctcccaggatgcccagtccctgcactcgggggccagccggaggagccagaagaggcttcagagtccctcaaagcaagcccagccactcgacgaccctgaagctgagcaactcaccgtagtggggaagatttccttcaatcccaaggacgtgctgggccgcggggcaggcgggactttcgttttccggggacagtttgagggacgggcagtggctgtcaagcggctcctccgcgagtgctttggcctggttcggcgggaagttcaactgctgcaggagtctgacaggcaccccaacgtgctccgctacttctgcaccgagcggggaccccagttccactacattgccctggagctctgccgggcctccttgcaggagtgcaccgggacctgaagccaggaaatattctcatcaccgggcctgacagccagggcctgggcagagtggtgctc

SEQ ID NO: 129772 - DNA, 980 bp, Homo sapiens
  Payload ID: 5384
  Gene Symbol: ERN2
  Gene Name: endoplasmic reticulum to nucleus signaling 2
  ENST ID: ENST00000569903
  CDS Start-End: 24-266
agccgtgcagctgcccaggcgctatggcgagtgcggtcagggggtcgaggccgtggccccggctggggctccagctccagttcgcggcgctgctgctcgggacgctgagtccacaggggtgcggctgggccacccggatgttaggcctcctgctgggagctcagcctcaccctgtttgctcaaggagggactggagcaggttcatactctcaggccagagaacctcctgctggtgtccaccttggatggaagtctccacgcactaagcaagcagacaggggacctgaagtggactctgagggatgatcccgtcatcgaaggaccaatgtacgtcacagaaatggcctttctctctgacccagcagatggcagcctgtacatcttggggacccaaaaacaacagggattaatggtttgtatcccatggtgttcgggaatgggtgagagccagggctttcgtcagctggagcactgagaggtggagaggcagtatggtcagtatctcctgttctgcagaggatataagtcaggactcagcacattgtgagaaggctgtctgagggacctgttgaaagggtggtaaggggaggtctggctgtgtctgcagggcaatctgactatcaagctggaggtatcccagggccttctccaggactctgagggctttaaagagaaatgtatataccagttagcttttgctaaataaaaatcaacccaaaactcaagagcttaaaactaaaacatcacttaaatttattcaactcagaatttggtgagatgacaatttaggttgggctcagcacagtggttcttctgctggtcttgactgaacttgttcatgcatgtgtggtcagctgctagtcaactggatggctgtgtttctgaaagttggttggtagttggttggcttttggcagaggtggctgggccatatgtctcttatccctagcaggcaagcctaggcttgttcacatgatatc

SEQ ID NO: 129773 - DNA, 3616 bp, Homo sapiens
  Payload ID: 5384
  Gene Symbol: ERN2
  Gene Name: endoplasmic reticulum to nucleus signaling 2
  ENST ID: ENST00000634482
  CDS Start-End: 170-3094
gcttgtacctgctgtgcagtgaggactccaggaactgatgatgaaccggcacggtcctcggcacgtggcaagttctccataagtgggctcagtaaaatccctctcccgggaaagcgccccaccgtgtttggtggggtgactgggacgcgaggatgcggctgggagtgtgatgagaagggcggggatcggcgaggactccaggctggggttgcaggcccagccaggggcggagccttctccgggtcgggcggggacagagcgctcccttggaggcacccagggacctggccagccgtgcagctgcccaggcgctatggcgagtgcggtcagggggtcgaggccgtggccccggctggggctccagctccagttcgcggcgctgctgctcgggacgctgagtccacaggttcatactctcaggccagagaacctcctgctggtgtccaccttggatggaagtctccacgcactaagcaagcagacaggggacctgaagtggactctgagggatgatcccgtcatcgaaggaccaatgtacgtcacagaaatggcctttctctctgacccagcagatggcagcctgtacatcttggggacccaaaaacaacagggattaatgaaactgccattcaccatccctgagctggttcatgcctctccctgccgcagctctgatggggtcttctacacaggccggaagcaggatgcctggtttgtggtggaccctgagtcaggggagacccagatgacactgaccacagagggtccctccaccccccgcctctacattggccgaacacagtatacggtcaccatgcatgacccaagagccccagccctgcgctggaacaccacctaccgccgctactcagcgccccccatggatggctcacctgggaaatacatgagccacctggcgtcctgcgggatgggcctgctgctcactgtggacccaggaagcgggacggtgctgtggacacaggacctgggcgtgcctgtgatgggcgtctacacctggcaccaggacggcctgcgccagctgccgcatctcacgctggctcgagacactctgcatttcctcgccctccgctggggccacatccgactgcctgcctcaggcccccgggacacagccaccctcttctctaccttggacacccagctgctaatgacgctgtatgtggggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcagcaacagccgcaggtggtggagaagcagcaggagacccccctggcacctgcagactttgctcacatctcccaggatgcccagtccctgcactcgggggccagccggaggagccagaagaggcttcagagtccctcaaagcaagcccagccactcgacgaccctgaagctgagcaactcaccgtagtggggaagatttccttcaatcccaaggacgtgctgggccgcggggcaggcgggactttcgttttccggggacagtttgagggacgggcagtggctgtcaagcggctcctccgcgagtgctttggcctggttcggcgggaagttcaactgctgcaggagtctgacaggcaccccaacgtgctccgctacttctgcaccgagcggggaccccagttccactacattgccctggagctctgccgggcctccttgcaggagtacgtagaaaacccggacctggatcgcgggggtctggagcccgaggtcgtgctgcagcagctgatgtctggcctggcccacctgcactctttacacatagtgcaccgggacctgaagccaggaaatattctcatcaccgggcctgacagccagggcctgggcagagtggtgctctcagacttcggcctctgcaagaagctgcctgctggccgctgtagcttcagcctccactccggcatccccggcacggaaggctggatggcgcccgagcttctgcagctcctgccaccagacagtcctaccagcgctgtggacatcttctctgcaggctgcgtgttctactacgtgctttctggtggcagccacccctttggagacagtctttatcgccaggcaaacatcctcacaggggctccctgtctggctcacctggaggaagaggtccacgacaaggtggttgcccgggacctggttggagccatgttgagcccactgccgcagccacgcccctctgccccccaggtgctggcccaccccttcttttggagcagagccaagcaactccagttcttccaggacgtcagtgactggctggagaaggagtccgagcaggagcccctggtgagggcactggaggcgggaggctgcgcagtggtccgggacaactggcacgagcacatctccatgccgctgcagacagatctgagaaagttccggtcctataaggggacatcagtgcgagacctgctccgtgctgtgaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccgccagactcagaggccaggaggccatgccctggggccacagggaggtgaggtgggctggatgccacacagatggtctccgtgctggctcactgaagagctgagcctgtggctggcctcagaatcaggctgggtgcagtggctcacacctgtaatcccagcattttgggaggctgagtgagaggatcacttgagctcaggagttcgagaccagcctggccaacatggcaacaccccatttctacaaaaaatttgtaaaattagccaggcatggtggcgcacgcctgtagtcccagctgcttgggaggctgaggtgggagaatcacttgagcccaggagttcgaggctgcagtgagccaggatcatgccactgcactccagcctggtccacagagagacactgtcaccccctttcccccacaagactggcagaggctgggcagcctggggctgatgaagcagagatgttcgctggatcccaggccctggcacccctcaggaaatacaagaaaaagaatattcacatctgtttaatgtgcataaagccaaggaaaggacagttccgaattcaat

SEQ ID NO: 129774 - DNA, 3952 bp, Homo sapiens
  Payload ID: 5385
  Gene Symbol: ERGIC1
  Gene Name: endoplasmic reticulum-golgi intermediate compartment 1
  Uniprot ID: Q969X5
  ENST ID: ENST00000326654
  CDS Start-End: 216-695
gaagcccaggctctccttagttgactgtgtgttaatcacccagcaatttcattactcaacagctctccagagttgcacattacagctggggtagaaattgggtgctgaaggccaggcagagcatttggctgtagggaggccgatcctcctcgggcctgttaccggcgggtctttgttcttagacctggggttcttggcctcacggattccaaggaatggaacgttgggccatgcgtgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtatggaagccctgcctcagccctttctacctgctcccctttcctgctgtctccccgctccctggaaactggttgtggaggcactcactcgacctgaccctgacacagcccccagcaagcgagggttcgtgtccagctgcctggccgttcctgctgagaatctggatgggggtccaggctccctggggttttaagcccctgatggctggttcaggaaggagctactcttctctccagtgagggggacaatgatgagaagacctgaggatttgcagcccccagccctgggttcaagtcccagctctaccccttcttggcccctacaagtcacttgacccatcttaggctgagggtgtgatggcgataatagtatcacgataccacccacttcacaaagtttgtgtggggattaaatgagctaatgcagattcattcattcagaaaaatttttgaatggcacgttctgtgttccagggtcggtgataggctctggggcagcgttcctgggctggtggggctcccattctggtagagggagacagtctacaaaccagaaagcatcagggatgctaagtgcagtgatgaggaataaagccaaggggagtgagatgaggtgggcttgaaagtaccttgtccgctcagaaggaccattcaaggttcactgttgttttgtcctcagaaccaggagcttcagatcctaagtcaagtgggtgaacgcagtgcccttgggagggccgaggcacccggtggcagctggcagggttttgctcagcacgtgccggccttcctcgaagctcggtactgtcacagtggagcctctcaacaacgctgtgaggcagcaccatttgacaggttaggatgctggggcccagagaggttaagtgtcttgcccgaggtcacacagctatctgcatgtcccacaactccccttcccagccccagccaaactgagccactggccactcctggcttctccttgtccctcctgcagcctctgctcagaacgcccttcctccagaccctgacacctgagctggggttgcaaagtcactggccacatccagcccaaagataaattttgtttgtccagtatagcatttaactgcatcagaaccagtatgaaaagaccaggaatccagatttctggcttttaaaagtcagaggctctcactacactgggtccgtgttcccgctatgacaatgacctggcaccaatgggcagtgttcccctttagagagggtgtgtgctgtcccttcccacagtccctggcaggcggctggaaggccaggcctggtcatctgtcaagcagggtggacttcttacgtgacagttcagggctcccttaagtgctaaagcagaagctgcaaggctttcttaaggtttcgagtgttgctgggagaaatctgctgcatgttgtgggttaaagggagtctctcaccagcccaggccctcaggaggaggagataccaggaggcagggatgctgggggtcgtggttcactgggggctctctctgcccatgagctgccacacagcacctttgccatgccccgtaatttggattttatggtggttgtgatggaaagccatttgagggttttgaacagggaggcaatgtaatcagatttatgccttagaactggactatccaataggttgccaccagccacataaggctatttaaattaattcaaattaaatgtacaattcagtcactcattctcatcaaccacatttcaagtgctcaaagccacgtgctggctaggggccacagcgttagacagtgcagagagaaagcacttccatcgctgaggaaagttctgctggaccgcacacccttagaaggatggctctggtggccgggcgcggtggctcaaacctgtaatcccagcactttgggaggccgaggtgggtggatcacgaggtcaggagatcgagaccatcccggctaacatggtgaaaccctgcctctactaaaaatacaaaaaaaaacaaaattagccgggcgtggttgcgggcacctgtagtcccagctactcaggaggctgaggcgggagaatggcatgaacccgggaggtggagcttgcagtgagccaagatcgtaccactgcactccagtctgggcgacagagtgagactccatctcaaaacaaacaaaaaaaggatggggctgggctggagagggtggcaggcagtggttgtggcagtggagctggggagatgtggtcggattagggaggtagaatcaataagactcagtgaagaatcggatgtgggggtaagggcacatgtggaagcaaagaaacctttgacgtctttgtcttgacaaccgggtggtcctgtttctagacatggaagcttagaaaagcctggagtctgtgggaagtaggtagggctgggcactggtcattccactctggtttcctttggggttcccattaggtgtctacagggagaggtgaaattggaagttggaggtgtggagagttcaggagagggttctggaccacagatgttgaggtgggagtcattagtgaatagatgatgttggaagtcatgggtcctcagagtgggggctccttaagcctccaggccagcagcatcagcatcacctgggagattgttaggaatgcagattctcaggcccccctaagacccaccgactctgtgctagaacaagcgcccctcagagattctgatgccactgaagtttgaggagcattggtttaagcaagattacctacggagaggctgtagatccgtgttctaaacctggggtccacagacacccccaagaagagcggattgaatgcaagagatctatgaagttggatgggggaaaaattgacatctttatttttgctaaactcgatctaaagtttagcatttccatctgcgatgaatgtaggccacaaaccacagtagtattagcagtgcctgggacctcctcaacaacagaaattgccggtatttatagcacgttacagttgttgcagataatttccagagactgtttatatgcaccactgttttaaaattacggtgattggccaggtgcagtggctcacacctgtaatcccagcactttgggaggccaaagtgggtggatcacttgaggagttcaagaccagcctggtcaacatgtcaaaaccctgtacctacaaaaaaatacaaaagttaaccaagcctatgcttgtagtcacagctactcgggaggccgaggtgggagggtcttctgagcccagggaggtagaggcttcagtgagctgagatcgcaccaccacactccagcctgggtgacagagtgaaacccttaatcaatcagtcaataaaaattacagtaattattagacccaccactaggtcatcttatttgatgcatcagtaaagcagcatattcaaatgtggatttttaaatattttaattactatttaaatatctctttactttgtaatcctatgcattttacgcattaaaacattttaagcatttaaaa

SEQ ID NO: 129775 - DNA, 2881 bp, Homo sapiens
  Payload ID: 5385
  Gene Symbol: ERGIC1
  Gene Name: endoplasmic reticulum-golgi intermediate compartment 1
  Uniprot ID: Q969X5
  ENST ID: ENST00000393784
  CDS Start-End: 140-1012
ggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaata

SEQ ID NO: 129776 - DNA, 586 bp, Homo sapiens
  Payload ID: 5385
  Gene Symbol: ERGIC1
  Gene Name: endoplasmic reticulum-golgi intermediate compartment 1
  ENST ID: ENST00000523291
  CDS Start-End: 4-420
acgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggaagttgaccagcagccagatgtcagagtttgcgtgttttgagcagcagcggcagcctcaccagagaccccacggtgacctcgtttcatcagccagccccgcaggaggaggacaggatggggtgaggggtatggggcctggctccagctatatgtttttaaaatccatcagagacactgacgtaggttcctaagtcacaggctctaaa

SEQ ID NO: 129777 - DNA, 539 bp, Homo sapiens
  Payload ID: 5385
  Gene Symbol: ERGIC1
  Gene Name: endoplasmic reticulum-golgi intermediate compartment 1
  ENST ID: ENST00000520642
  CDS Start-End: 30-197
gcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttggttgggcttgacattcaggatgagatgggcaggcacgaagtgggccacatcgacaactccatgaagatcccgctgaacaatggggcaggctgccgcttcgaggggcagttcagcatcaacaagaaccaggagcttcagatcctaagtcaagtgggtgaacgcagtgcccttgggagggccgaggcacccggtggcagctggcagggttttgctcagcacgtgccggccttcctcgaagctcggtactgtcacagtggagcctctcaacaacgctgtgaggcagcaccatttgacaggtccccggcaacttccacgtgtccacacacagtgccacagcccagccacagaaccca

SEQ ID NO: 129778 - DNA, 578 bp, Homo sapiens
  Payload ID: 5385
  Gene Symbol: ERGIC1
  Gene Name: endoplasmic reticulum-golgi intermediate compartment 1
  ENST ID: ENST00000519796
  CDS Start-End: 1-163
tgtgaacgagctctatgtcgatgacccagacaaggacagcggtggcaagatcgacgtcagtctgaacatcagtttacccaatctgcactgcgagttctttggaccccagaccatgagctcctggaggtccccagcccggcctgcccctgcaatggatgaatgaaggctcccagagagaacaggctggcccccatcctcccgcgtctctgggtttgtgactgttgtctccctttggctcctgcagtggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggt

SEQ ID NO: 129779 - DNA, 554 bp, Homo sapiens
  Payload ID: 5385
  Gene Symbol: ERGIC1
  Gene Name: endoplasmic reticulum-golgi intermediate compartment 1
  ENST ID: ENST00000518247
  CDS Start-End: 239-554
aggcagcttcctggctgggaagggaagcccaggctctccttagttgactgtgtgttaatcacccagcaatttcattactcaacagctctccagagttgcacattacagctggggtagaaattgggtgctgaaggccaggcagagcatttggctgtagggaggccgatcctcctcgggcctgttaccggcgggtctttgttcttagacctggggttcttggcctcacggattccaaggaatggaacgttgggccatgcgtgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatcc

SEQ ID NO: 129780 - DNA, 2818 bp, Homo sapiens
  Payload ID: 5386
  Gene Symbol: ENSA
  Gene Name: endosulfine alpha
  Uniprot ID: O43768
  ENST ID: ENST00000271690
  CDS Start-End: 108-461
agtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaaca

SEQ ID NO: 129781 - DNA, 633 bp, Homo sapiens
  Payload ID: 5386
  Gene Symbol: ENSA
  Gene Name: endosulfine alpha
  Uniprot ID: O43768
  ENST ID: ENST00000339643
  CDS Start-End: 107-520
gtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggattataaatcattacattggagtgtgcttctctgtgcggatgaaatgcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctc

SEQ ID NO: 129782 - DNA, 2546 bp, Homo sapiens
  Payload ID: 5386
  Gene Symbol: ENSA
  Gene Name: endosulfine alpha
  ENST ID: ENST00000356527
  CDS Start-End: 108-530
agtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggtatggggcatagtctcttaccctctttctttggagctaaaggaggttcttcgaatgaagtctgtagagcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttg

SEQ ID NO: 129783 - DNA, 792 bp, Homo sapiens
  Payload ID: 5386
  Gene Symbol: ENSA
  Gene Name: endosulfine alpha
  Uniprot ID: O43768
  ENST ID: ENST00000361532
  CDS Start-End: 36-389
ggcgggtggttggaaagacggtgaatggaaaggggatggctggtggtcttgggtgtgatgtgtgttattggtttgtagaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcct

SEQ ID NO: 129784 - DNA, 703 bp, Homo sapiens
  Payload ID: 5386
  Gene Symbol: ENSA
  Gene Name: endosulfine alpha
  Uniprot ID: O43768
  ENST ID: ENST00000362052
  CDS Start-End: 108-425
agtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggtatggggcatagtctcttaccctctttctttggagctaaaggaggttcttcgaatgaagtctgtagaggttctactggatccttttctggaggttttgttgttgaacagaagtagaggcgaatttgaaatttgaaaagagcaagtcaaattaatgtaaatccctgatgtggtatcaattccctcctgatttcccatgtaggaaattaaggcctaaattggagcatttgggtgtgtggggaaatgagggaaagatgttagaaactgaaatgcagactgcccccaggcatttgcctgtttgaatgttggaggttttaggattgtgcactttttaagcattagagataaattttgggatgcatcatttcagaagaagatcaaaccatctctcctacagaaataaatcctcaactt

SEQ ID NO: 129785 - DNA, 725 bp, Homo sapiens
  Payload ID: 5386
  Gene Symbol: ENSA
  Gene Name: endosulfine alpha
  Uniprot ID: O43768
  ENST ID: ENST00000361631
  CDS Start-End: 24-425
gaaagacggtgaatggaaaggggatggctggtggtcttgggtgtgatgtgtgttattggtttgtagaggacacgcaggagaaagaaggtattctgcctgagagagctgaagaggcaaagctaaaggccaaatacccaagcctaggacaaaagcctggaggctccgacttcctcatgaagagactccagaaaggggattataaatcattacattggagtgtgcttctctgtgcggatgaaatgcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggagg

SEQ ID NO: 129786 - DNA, 2085 bp, Homo sapiens
  Payload ID: 5386
  Gene Symbol: ENSA
  Gene Name: endosulfine alpha
  Uniprot ID: O43768
  ENST ID: ENST00000369014
  CDS Start-End: 127-492
attttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaatattctgaagcagttggtgtgttttattggggtttgggagggggaagaaaacaatactgaagacattgttaatgtgagatgcggctgagttccccaataccatcacttaggaaagggagcaggaatgttggcataaaccttgcccatccctttgtttctgtaaccaatgtagaaggtgcatcaacctcagtttgtggctcacaaaatgaggcatttaagatatttgatctaaatggtttcttgacacctaagcctagtccaggtttagcagaaaaggaggcccagtctccttttccctctgtcttccattccttttcaagttcccatgtttgtgagggagaaatgtgacaaaccaaaagaaatatattatttctttgtaataagccaaaagaaactcaagtctttctgctggtggccagcaggaggcagagtgatttctttcctcatgatgtgccaatctgcattgctggaaacctgctactgaaagaagttaaaagctgcctgtgaatgtaacgtacaaaagaaaggttaccaaaggagaaaaaactccagcgggtgtacggtggctcacgcctataattccagcactttgggaggccaaggtgggtggatcacttgaggtcaggagtttgagaccagcctagccaacatggtgaaaccccatctctactaaaaatacaaaaattagccgggcgtggcggcacatgcctataatcccacttacttgggaggctgaggtaggagaatcgcttgaacccaggaggcagagtttgcagtgagccgagattgtgccattgcactccagcctgggcgacagagcgagactccatctaaaaaaaataaatgaataaaataaaacaagtacaaatttaaa

SEQ ID NO: 129787 - DNA, 923 bp, Homo sapiens
  Payload ID: 5386
  Gene Symbol: ENSA
  Gene Name: endosulfine alpha
  ENST ID: ENST00000369016
  CDS Start-End: 97-660
ccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggattataaatcattacattggagtgtgcttctctgtgcggatgaaatgcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggacaaagttttgctcttgtcgcccaggctggagtgcaatggcatgatctctgcttactgcaacctctgcctcctgggttcaagcgattctcctgcctcagcctcctgagtagctgggattacaggcatgcaacaccacgcccggctaattttgtaatttttttgtagagacggggtttcatcacgttagccaggctggtctcaaactcctgacctcaggtaatccacccacctcggcctcccaaagtgctgggattacaggcatgagccactgcacctggcctctctacggtaaatattgaaagttgctgggtcacagggtatgcacatttaaattttttttttctttttaaagggacagagtcttgctctgttgcccaggctggagtacagtgacgcaatcttggctcaatgcaacctccgcctcccgg

SEQ ID NO: 129788 - DNA, 793 bp, Homo sapiens
  Payload ID: 5386
  Gene Symbol: ENSA
  Gene Name: endosulfine alpha
  Uniprot ID: O43768
  ENST ID: ENST00000503345
  CDS Start-End: 112-429
ccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggtatggggcatagtctcttaccctctttctttggagctaaaggaggttcttcgaatgaagtctgtagaggttctactggatccttttctggaggttttgttgttgaacagaagtagaggcgaatttgaaatttgaaaagagcaagtcaaattaatcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttattt

SEQ ID NO: 129789 - DNA, 1369 bp, Homo sapiens
  Payload ID: 5386
  Gene Symbol: ENSA
  Gene Name: endosulfine alpha
  Uniprot ID: O43768
  ENST ID: ENST00000513281
  CDS Start-End: 12-353
atggaaaggggatggctggtggtcttgggtgtgatgtgtgttattggtttgtagaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggc

SEQ ID NO: 129790 - DNA, 574 bp, Homo sapiens
  Payload ID: 5386
  Gene Symbol: ENSA
  Gene Name: endosulfine alpha
  Uniprot ID: O43768
  ENST ID: ENST00000503241
  CDS Start-End: 90-491
agcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggattataaatcattacattggagtgtgcttctctgtgcggatgaaatgcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagat

SEQ ID NO: 129791 - DNA, 716 bp, Homo sapiens
  Payload ID: 5386
  Gene Symbol: ENSA
  Gene Name: endosulfine alpha
  Uniprot ID: O43768
  ENST ID: ENST00000509582
  CDS Start-End: 33-350
ggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggtatggggcatagtctcttaccctctttctttggagctaaaggaggttcttcgaatgaagtctgtagaggttctactggatccttttctggaggttttgttgttgaacagaagtagaggcgaatttgaaatttgaaaagagcaagtcaaattaatgattataaatcattacattggagtgtgcttctctgtgcggatgaaatgcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgg

SEQ ID NO: 129792 - DNA, 1826 bp, Homo sapiens
  Payload ID: 5387
  Gene Symbol: ESAM
  Gene Name: endothelial cell adhesion molecule
  Uniprot ID: Q96AP7
  ENST ID: ENST00000278927
  CDS Start-End: 131-1303
gggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgagataagaaacaa

SEQ ID NO: 129793 - DNA, 1833 bp, Homo sapiens
  Payload ID: 5387
  Gene Symbol: ESAM
  Gene Name: endothelial cell adhesion molecule
  ENST ID: ENST00000417453
  CDS Start-End: 127-864
tggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacaggtcagtgagggggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgagataagaaacaa

SEQ ID NO: 129794 - DNA, 560 bp, Homo sapiens
  Payload ID: 5387
  Gene Symbol: ESAM
  Gene Name: endothelial cell adhesion molecule
  Uniprot ID: Q96AP7
  ENST ID: ENST00000444566
  CDS Start-End: 137-560
agacttgggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggtgaggtctcctttaggtctcagtttctctgcccctaaaatggagtggctctggaaatggagagatgctcatttctacagagactcctacctcagtaagtggt

SEQ ID NO: 129795 - DNA, 581 bp, Homo sapiens
  Payload ID: 5387
  Gene Symbol: ESAM
  Gene Name: endothelial cell adhesion molecule
  ENST ID: ENST00000435477
  CDS Start-End: 137-581
agacttgggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggca

SEQ ID NO: 129796 - DNA, 1035 bp, Homo sapiens
  Payload ID: 5388
  Gene Symbol: ECSCR
  Gene Name: endothelial cell surface expressed chemotaxis and apoptosis regulator
  Uniprot ID: Q19T08
  ENST ID: ENST00000618155
  CDS Start-End: 74-691
actccctctctcttctccactatggacagagcctccactgagctgctgcctgcccgccacatacccagctgacatgggcaccgcaggagccatgcagctgtgctgggtgatcctgggcttcctcctgttccgaggccacaactcccagcccacaatgacccagacctctagctctcagggaggccttggcggtctaagtctgaccacagagccagtttcttccaacccaggatacatcccttcctcagaggctaacaggccaagccatctgtccagcactggtaccccaggcgcaggtgtccccagcagtggaagagacggaggcacaagcagagacacatttcaaactgttccccccaattcaaccaccatgagcctgagcatgagggaagatgcgaccatcctgcccagccccacgtcagagactgtgctcactgtggctgcatttggtgttatcagcttcattgtcatcctggtggttgtggtgatcatcctagttggtgtggtcagcctgaggttcaagtgtcggaagagcaaggagtctgaagatccccagaaacctgggagttcagggctgtctgaaagctgctccacagccaatggagagaaagacagcatcacccttatctccatgaagaacatcaacatgaataatggcaaacaaagtctctcagcagagaaggttctttaaaagcaactttgggtccccatgagtccaaggatgatgcagctgccctgtgactacaaggaggaagagatggaattagtagaggcaatgaaccacatgtaaattattttattgtttcatgtctgcttctagatctaaaggacactagcattgccccagatctgggagcaagctaccaacaggggagactctttcctgtatggacagctgctgtggaaatactgcctgcttctcccacctcctcagagccacaggaaagaggaggtgacagagagagagcaaggaaagtgatgaggtggattgatactttctactttgcattaaaattattttctagcctgcagtct

SEQ ID NO: 129797 - DNA, 1002 bp, Homo sapiens
  Payload ID: 5389
  Gene Symbol:
  Gene Name: endothelial cell surface expressed chemotaxis and apoptosis regulator [Source:EntrezGene Acc:641700]
  Uniprot ID: Q19T08
  ENST ID: ENST00000515823
  CDS Start-End: 38-655
actgagctgctgcctgcccgccacatacccagctgacatgggcaccgcaggagccatgcagctgtgctgggtgatcctgggcttcctcctgttccgaggccacaactcccagcccacaatgacccagacctctagctctcagggaggccttggcggtctaagtctgaccacagagccagtttcttccaacccaggatacatcccttcctcagaggctaacaggccaagccatctgtccagcactggtaccccaggcgcaggtgtccccagcagtggaagagacggaggcacaagcagagacacatttcaaactgttccccccaattcaaccaccatgagcctgagcatgagggaagatgcgaccatcctgcccagccccacgtcagagactgtgctcactgtggctgcatttggtgttatcagcttcattgtcatcctggtggttgtggtgatcatcctagttggtgtggtcagcctgaggttcaagtgtcggaagagcaaggagtctgaagatccccagaaacctgggagttcagggctgtctgaaagctgctccacagccaatggagagaaagacagcatcacccttatctccatgaagaacatcaacatgaataatggcaaacaaagtctctcagcagagaaggttctttaaaagcaactttgggtccccatgagtccaaggatgatgcagctgccctgtgactacaaggaggaagagatggaattagtagaggcaatgaaccacatggctggatggggcagcatctcaatcatatagggcacaggacagacctcagtatcaccagcaagaatccattacagttcaacatgtagtacctccagaccttttccctgtgcccctggactccaaggtctatcccaccctcagctgtccatcttctagagcaggcggtctagcctccccaaaccagaagaacttcctttttatattcaaccacctgatggatgtccctgatcagttccctcagctgcagagca

SEQ ID NO: 129798 - DNA, 1326 bp, Homo sapiens
  Payload ID: 5390
  Gene Symbol: ESM1
  Gene Name: endothelial cell-specific molecule 1
  Uniprot ID: Q9NQ30
  ENST ID: ENST00000381403
  CDS Start-End: 77-481
agctaccagtttggacggctgcttcccaccagcaaagaccacgactggagagccgagccggaggcagctgggaaacatgaagagcgtcttgctgctgaccacgctcctcgtgcctgcacacctggtggccgcctggagcaataattatgcggtggactgccctcaacactgtgacagcagtgagtgcaaaagcagcccgcgctgcaagaggacagtgctcgacgactgtggctgctgccgagtgtgcgctgcagggcggggagaaacttgctaccgcacagtctcaggcatggatggcatgaagtgtggcccggggctgaggtgtcagccttctaatggggaggatccttttggtgaagagtttggtatctgcaaagagcatgacatggcatctggagatggcaatattgtgagagaagaagttgtgaaagagaatgctgccgggtctcccgtaatgaggaaatggttaaatccacgctgatcccggctgtgatttctgagagaaggctctattttcgtgattgttcaacacacagccaacattttaggaactttctagattatagcataaggacatgtaatttttgaagaccaaatgtgatgcatggtggatccagaaaacaaaaagtaggatacttacaatccataacatccatatgactgaacacttgtatgtgtttgttaaatattcgaatgcatgtagatttgttaaatgtgtgtgtatagtaacactgaagaactaaaaatgcaatttaggtaatcttacgtggagacaggtcaaccaaagagggagctaggcaaagctgaagaccgcagtgagtcaaattagttctttgactttgatgtacattaatgttgggatatggaatgaagacttaagagcaggagaagatggggagggggtgggagtgggaaataaaatatttagcccttccttggtaggtagcttctctagaatttaattgtgcttttttttttttttttggctttgggaaaagtcaaaataaaacaaccagaaaacccctgaaggaagtaagatgtttgaagcttatggaaatttgagtaacaaacagctttgaactgagagcaatttcaaaaggctgctgatgtagttcccgggttacctgtatctgaaggacggttctggggcataggaaacacatacacttccataaatagctttaacgtatgccacctcagagataaatctaagaagtattttacccactggtggtttgtgtgtgtatgaaggtaaatatttatatatttttataaataaatgtgttagtgcaagtcatcttccctacccatatttatcatcctctt

SEQ ID NO: 129799 - DNA, 2169 bp, Homo sapiens
  Payload ID: 5390
  Gene Symbol: ESM1
  Gene Name: endothelial cell-specific molecule 1
  Uniprot ID: Q9NQ30
  ENST ID: ENST00000381405
  CDS Start-End: 147-701
ggaaattgatgacgggaaagcatgcgggcaacccagtgtataaaactcataaacgtgtaggcagaggctcagctaccagtttggacggctgcttcccaccagcaaagaccacgactggagagccgagccggaggcagctgggaaacatgaagagcgtcttgctgctgaccacgctcctcgtgcctgcacacctggtggccgcctggagcaataattatgcggtggactgccctcaacactgtgacagcagtgagtgcaaaagcagcccgcgctgcaagaggacagtgctcgacgactgtggctgctgccgagtgtgcgctgcagggcggggagaaacttgctaccgcacagtctcaggcatggatggcatgaagtgtggcccggggctgaggtgtcagccttctaatggggaggatccttttggtgaagagtttggtatctgcaaagactgtccctacggcaccttcgggatggattgcagagagacctgcaactgccagtcaggcatctgtgacagggggacgggaaaatgcctgaaattccccttcttccaatattcagtaaccaagtcttccaacagatttgtttctctcacggagcatgacatggcatctggagatggcaatattgtgagagaagaagttgtgaaagagaatgctgccgggtctcccgtaatgaggaaatggttaaatccacgctgatcccggctgtgatttctgagagaaggctctattttcgtgattgttcaacacacagccaacattttaggaactttctagattatagcataaggacatgtaatttttgaagaccaaatgtgatgcatggtggatccagaaaacaaaaagtaggatacttacaatccataacatccatatgactgaacacttgtatgtgtttgttaaatattcgaatgcatgtagatttgttaaatgtgtgtgtatagtaacactgaagaactaaaaatgcaatttaggtaatcttacgtggagacaggtcaaccaaagagggagctaggcaaagctgaagaccgcagtgagtcaaattagttctttgactttgatgtacattaatgttgggatatggaatgaagacttaagagcaggagaagatggggagggggtgggagtgggaaataaaatatttagcccttccttggtaggtagcttctctagaatttaattgtgcttttttttttttttttggctttgggaaaagtcaaaataaaacaaccagaaaacccctgaaggaagtaagatgtttgaagcttatggaaatttgagtaacaaacagctttgaactgagagcaatttcaaaaggctgctgatgtagttcccgggttacctgtatctgaaggacggttctggggcataggaaacacatacacttccataaatagctttaacgtatgccacctcagagataaatctaagaagtattttacccactggtggtttgtgtgtgtatgaaggtaaatatttatatatttttataaataaatgtgttagtgcaagtcatcttccctacccatatttatcatcctcttgaggaaagaaatctagtattatttgttgaaaatggttagaataaaactatgactctataaggttttcaaacatctgaggcatgataaatttattatccataattatagtaataataaccttaataagcataagaaaaacagagtcactctggatttcaaaaatgtcaaaaaatgagcaacagagggtccttatttaaacataagtgctgtgacttaggtgaattttcaatttaaggtagaaaataagtttttaggaggtttgtaaaagaagaatcaattttcagcagaaaacatgtcaactttaaaatatagtttattttcatatttttttcttttaaacttggttgataagtggaattaggagtatatttgaaagaatcttagcacaaacaggactgttgtactagatgttcttaggaaatatctcagaagtattttatttgaagtgaagaacttatttaagaattatttcagtatttacctgtattttattcttgaagttggccaacagagttgtgaatgtgtgtgggaaggcctttgaatgtaaagctgcataagctgttaggttttgttttaaaaggacatgtttattattgttcaataaaaaagaacaagatacagct

SEQ ID NO: 129800 - DNA, 756 bp, Homo sapiens
  Payload ID: 5390
  Gene Symbol: ESM1
  Gene Name: endothelial cell-specific molecule 1
  ENST ID: ENST00000601836
  CDS Start-End: 488-756
gaacaaaaccaacgcagagcagtgacttcctgtcagagcagaagaggctctgagacaaagctacacctcaagtgatatgccagggtcagaacaattcccgtcctgaaggagggtgtgcaaccttctttatccctccttcacagacgtccttgagcccttgagacggatgtgagtgagtttttcagtcctcatgcaaaacaaccatctaaacataacagatgacatcagcttgggcttttcaattcctggatggcagcagcgtgttaatccagccttcatcctggatttcataaaccaaaacaagagagcctggcaggaggacagcgctgctgctgggttgaggaaattgatgacgggaaagcatgcgggcaacccagtgtataaaactcataaacgtgtaggcagaggctcagctaccagtttggacggctgcttcccaccagcaaagaccacgactggagagccgagccggaggcagctgggaaacatgaagagcgtcttgctgctgaccacgctcctcgtgcctgcacacctggtggccgcctggagcaataattatgcggtggactgccctcaacactgtgacagcagtgagtgcaaaagcagcccgcgctgcaagaggacagtgctcgacgactgtggctgctgccgagtgtgcgctgcagggcggggagaaacttgctaccgcacagtctcaggcatggatggcatgaagtgtggcccggggctgaggtgtcagccttctaatggggagga

SEQ ID NO: 129801 - DNA, 640 bp, Homo sapiens
  Payload ID: 5391
  Gene Symbol: EDF1
  Gene Name: endothelial differentiation-related factor 1
  Uniprot ID: O60869
  ENST ID: ENST00000224073
  CDS Start-End: 29-475
gccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcg

SEQ ID NO: 129802 - DNA, 809 bp, Homo sapiens
  Payload ID: 5391
  Gene Symbol: EDF1
  Gene Name: endothelial differentiation-related factor 1
  Uniprot ID: O60869
  ENST ID: ENST00000371648
  CDS Start-End: 9-428
cgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattggtgagtgtccctccacccttcgccgggtccgctgaacagggaggctacccgctcccagctggggttggtgagagtgggactcgggggaagaagatggccctgggggtcccctgttctctgaattctggagctttgcttctccaggtagtacagactgagggatggtggggtctctgcaggcctcaggaaacccctaagagcaagtggagtccgagtcccttccccttgccagttcccgtcagcctgtgctgttggcgatggttctctgagcctgagcacagcgggtccgggccctgtcagcatggggccggaagccagttccacagaggaccccggctccggttcttccggagaggggtgttcatgctctgctgtctaaggtgatcagactcatcctcttcaaaattagatgtggg

SEQ ID NO: 129803 - DNA, 790 bp, Homo sapiens
  Payload ID: 5391
  Gene Symbol: EDF1
  Gene Name: endothelial differentiation-related factor 1
  Uniprot ID: O60869
  ENST ID: ENST00000371649
  CDS Start-End: 28-453
ccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattgatgtgggaaccaggagtgctcgtgtgctgagagcccagtgaggcacgggagcggcgtggccccccttccctgggaagatgttgaagaggggcagcgttggggggaggagggagctggtgctgcagtggccagtggctgtggctcatttcaggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcg

SEQ ID NO: 129804 - DNA, 5166 bp, Homo sapiens
  Payload ID: 5392
  Gene Symbol: EPAS1
  Gene Name: endothelial PAS domain protein 1
  Uniprot ID: Q99814
  ENST ID: ENST00000263734
  CDS Start-End: 511-3123
gctttacactcgcgagcggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccagggagcccaggtgctcggcgtctgaacgtctcaaagggccacagcgacaatgacagctgacaaggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtggagctaacaggacatagtatctttgacttcactcatccctgcgaccatgaggagattcgtgagaacctgagtctcaaaaatggctctggttttgggaaaaaaagcaaagacatgtccacagagcgggacttcttcatgaggatgaagtgcacggtcaccaacagaggccgtactgtcaacctcaagtcagccacctggaaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacagaatcacagaactgattggttaccaccctgaggagctgcttggccgctcagcctatgaattctaccatgcgctagactccgagaacatgaccaagagtcaccagaacttgtgcaccaagggtcaggtagtaagtggccagtaccggatgctcgcaaagcatgggggctacgtgtggctggagacccaggggacggtcatctacaaccctcgcaacctgcagccccagtgcatcatgtgtgtcaactacgtcctgagtgagattgagaagaatgacgtggtgttctccatggaccagactgaatccctgttcaagccccacctgatggccatgaacagcatctttgatagcagtggcaagggggctgtgtctgagaagagtaacttcctattcaccaagctaaaggaggagcccgaggagctggcccagctggctcccaccccaggagacgccatcatctctctggatttcgggaatcagaacttcgaggagtcctcagcctatggcaaggccatcctgcccccgagccagccatgggccacggagttgaggagccacagcacccagagcgaggctgggagcctgcctgccttcaccgtgccccaggcagctgccccgggcagcaccacccccagtgccaccagcagcagcagcagctgctccacgcccaatagccctgaagactattacacatctttggataacgacctgaagattgaagtgattgagaagctcttcgccatggacacagaggccaaggaccaatgcagtacccagacggatttcaatgagctggacttggagacactggcaccctatatccccatggacggggaagacttccagctaagccccatctgccccgaggagcggctcttggcggagaacccacagtccaccccccagcactgcttcagtgccatgacaaacatcttccagccactggcccctgtagccccgcacagtcccttcctcctggacaagtttcagcagcagctggagagcaagaagacagagcccgagcaccggcccatgtcctccatcttctttgatgccggaagcaaagcatccctgccaccgtgctgtggccaggccagcacccctctctcttccatggggggcagatccaatacccagtggcccccagatccaccattacattttgggcccacaaagtgggccgtcggggatcagcgcacagagttcttgggagcagcgccgttggggccccctgtctctccaccccatgtctccaccttcaagacaaggtctgcaaagggttttggggctcgaggcccagacgtgctgagtccggccatggtagccctctccaacaagctgaagctgaagcgacagctggagtatgaagagcaagccttccaggacctgagcgggggggacccacctggtggcagcacctcacatttgatgtggaaacggatgaagaacctcaggggtgggagctgccctttgatgccggacaagccactgagcgcaaatgtacccaatgataagttcacccaaaaccccatgaggggcctgggccatcccctgagacatctgccgctgccacagcctccatctgccatcagtcccggggagaacagcaagagcaggttccccccacagtgctacgccacccagtaccaggactacagcctgtcgtcagcccacaaggtgtcaggcatggcaagccggctgctcgggccctcatttgagtcctacctgctgcccgaactgaccagatatgactgtgaggtgaacgtgcccgtgctgggaagctccacgctcctgcaaggaggggacctcctcagagccctggaccaggccacctgagccaggccttctacctgggcagcacctctgccgacgccgtcccaccagcttcactctctccgtctgtttttgcaactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttttgtttaagctgactctttgctctaattttggaaaaaaagaaatgtgaagggtcaactccaacgtatgtggttatctgtgaaagttgcacagcgtggcttttcctaaactggtgtttttcccccgcatttggtggattttttattattattcaaaaacataactgagttttttaaaagaggagaaaatttatatctgggttaagtgtttatcatatatatgggtactttgtaatatctaaaaacttagaaacggaaatggaatcctgctcacaaaatcactttaagatcttttcgaagctgttaatttttcttagtgttgtggacactgcagacttgtccagtgctcccacggcctgtacggacactgtggaaggcctccctctgtcggctttttgccatctgtgatatgccataggtgtgacaatccgagcagtggagtcattcagcgggagcactgcgcgctatcccctcacattctctatgtactatgtatgtatgtattattattattgctgccaagagggtctgatggcacgttgtggggtcggggggtggggcggggaagtgctctaacttttcttaaggttttgttgctagcccttcaagtgcactgagctatgtgactcggatggtctttcacacggcacatttggacatttccagaactaccatgagatggtttagacgggaattcatgcaaatgaggggtcaaaaatggtatagtgaccccgtccacgtcctccaagctcacgaccttggagccccgtggagctggactgaggaggaggctgcacagcgggagagcagctggtccagaccagccctgcagcccccactcagccggcagccagatggccccgcaaggcctccagggatggcccctagccacaggccctggctgaggtctctgggtcggtcagtgacatgtaggtaggaagcactgaaaatagtgttcccagagcactttgcaactccctgggtaagagggacgacacctctggtttttcaataccaattacatggaacttttctgtaatgggtacaatgaagaagtttctaaaaacacacacaaagcacattgggccaactatttagtaagcccggatagacttattgccaaaaacaaaaaatagctttcaaaagaaatttaagttctatgagaaattccttagtcatggtgttgcgtaaatcatattttagctgcacggcattaccccacacagggtggcagaacttgaagggttactgacgtgtaaatgctggtatttgatttcctgtgtgtgttgccctggcattaagggcattttacccttgcagttttactaaaacactgaaaaatattccaagcttcatattaaccctacctgtcaacgtaacgatttcatgaacgttattatattgtcgaattcctactgacaacattataactgtatgggagcttaactttataaggaaatgtattttgacactggtatcttattaaagtattctgatcctaccactg

SEQ ID NO: 129805 - DNA, 1067 bp, Homo sapiens
  Payload ID: 5392
  Gene Symbol: EPAS1
  Gene Name: endothelial PAS domain protein 1
  ENST ID: ENST00000449347
  CDS Start-End: 289-1067
agatcacactggggaaccagactgacttctccaattctgaactcgccccggcctcgggcggctcaaagggcctcctctgccgcatccccgccaaaaccaaaccgcctggcacaagccgcccgccgcgcgccaccttccacctgactgcgcggggcgctcgggacctgcgcgcacctcggaccttcaccacccgcccgggccgcggggagcggacgagggccacagccccccacccgccagggagcccaggtgctcggcgtctgaacgtctcaaagggccacagcgacaatgacagctgacaaggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtggagctaacaggacatagtatctttgacttcactcatccctgcgaccatgaggagattcgtgagaacctgagtctcaaaaatggctctggttttgggaaaaaaagcaaagacatgtccacagagcgggacttcttcatgaggatgaagtgcacggtcaccaacagaggccgtactgtcaacctcaagtcagccacctggaaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacag

SEQ ID NO: 129806 - DNA, 2033 bp, Homo sapiens
  Payload ID: 5393
  Gene Symbol: EDN1
  Gene Name: endothelin 1
  Uniprot ID: P05305
  ENST ID: ENST00000379375
  CDS Start-End: 268-906
acgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagcacgttgttccgtatggacttggaagccctaggtccaagagagccttggagaatttacttcccacaaaggcaacagaccgtgaaaatagatgccaatgtgctagccaaaaagacaagaagtgctggaatttttgccaagcaggaaaagaactcagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagaccttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattcgggtggcatcctccggagagagagagaggaaggagattccacacaggggtggagtttctgacgaaggtcctaagggagtgtttgtgtctgactcaggcgcctggcacatttcagggagaaactccaaagtccacacaaagattttctaaggaatgcacaaattgaaaacacactcaaaagacaaacatgcaagtaaagaaaaaaaaaagaaagacttttgtttaaatttgtaaaatgcaaaactgaatgaaactgttactaccataaatcaggatatgtttcatgaatatgagtctacctcacctatattgcactctggcagaagtatttcccacatttaattattgcctccccaaactcttcccacccctgctgccccttcctccatcccccatactaaatcctagcctcgtagaagtctggtctaatgtgtcagcagtagatataatattttcatggtaatctactagctctgatccataagaaaaaaaagatcattaaatcaggagattccctgtccttgatttttggagacacaatggtatagggttgtttatgaaatatattgaaaagtaagtgtttgttacgctttaaagcagtaaaattattttcctttatataaccggctaatgaaagaggttggattgaattttgatgtacttatttttttatagatatttatattcaaacaatttattccttatatttaccatgttaaatatctgtttgggcaggccatattggtctatgtatttttaaaatatgtatttctaaatgaaattgagaacatgctttgttttgcctgtcaaggtaatgactttagaaaataaatatttttttccttactgta

SEQ ID NO: 129807 - DNA, 1241 bp, Homo sapiens
  Payload ID: 5394
  Gene Symbol: EDN2
  Gene Name: endothelin 2
  Uniprot ID: P20800
  ENST ID: ENST00000372587
  CDS Start-End: 71-607
cagcttaatagcaggacgctggcaacaggcactccctgctccagtccagcctgcgcgctccaccgccgctatggtctccgtgcctaccacctggtgctccgttgcgctagccctgctcgtggccctgcatgaagggaagggccaggctgctgccaccctggagcagccagcgtcctcatctcatgcccaaggcacccaccttcggcttcgccgttgctcctgcagctcctggctcgacaaggagtgcgtctacttctgccacttggacatcatctgggtgaacactcctgaacagacagctccttacggcctgggaaacccgccaagacgccggcgccgctccctgccaaggcgctgtcagtgctccagtgccagggaccccgcctgtgccaccttctgccttcgaaggccctggactgaagccggggcagtcccaagccggaagtcccctgcagacgtgttccagactggcaagacaggggccactacaggagagcttctccaaaggctgagggacatttccacagtcaagagcctctttgccaagcgacaacaggaggccatgcgggagcctcggtccacacattccaggtggaggaagagatagtgtcgtgagctggaggaacattgggaaggaagcccgcggggagagaggaggagagaagtggccagggcttgtggactctctgcctgcttcctggaccggggccttggtcccagacagctggacccatttgccaggattggcacaagctccctggtgagggagcctcgtccaaggcagttctgtgtcctcgcactgcccagggaagccctcggcctccagactgcggagcagcctccagtgctggctgctggcccacagctctgctggaagaactgcatggggagtacattcatctggaggctgcgtcctgaggagtgtcctgtctgctgggctacaaaccaggagcaaccgtgcagccacgaacacgcatgcctcagccagccctggaggctggatggctcccctgaggctggcatcctggctggctgtgtcctctccagctttccctccccagagttcttgcaccctcattccctcgggaccctcccagtgagaagggcctgctctgcttttcctgtctgtatataacttatttgccctaagaactttgagaatcccaattatttattttaatgtattttttagaccctctatttacctgcgaacttgtgtttataataaatgaggaaacata

SEQ ID NO: 129808 - DNA, 2655 bp, Homo sapiens
  Payload ID: 5395
  Gene Symbol: EDN3
  Gene Name: endothelin 3
  Uniprot ID: P14138
  ENST ID: ENST00000311585
  CDS Start-End: 371-1030
cctcgggccgctgcgctcctggccagctccccccagcgcctgggaggcgacccccagtgcgcccgggttcaaaggcccggcgaggcagttccagcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcagtaattcaaggacggcagaaaaaacagacaaagaagaggaagggaaggtgagaggtgccaacagaggcctgtgtcaaaggaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagcatcctggtctcgggaggcttctgtcattgctcacacacagttcagatttccacctctttatagacaagaagtgaatttgcctggggcagaacacccacccaaagagtccccacttaacaataccccccccccacggcaagaatgcccaaatccgaatgaccccagttttcctaatgagtaaaatgatcccagatgtgccccagagcatgacgcctgcagctccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgctctga

SEQ ID NO: 129809 - DNA, 2636 bp, Homo sapiens
  Payload ID: 5395
  Gene Symbol: EDN3
  Gene Name: endothelin 3
  Uniprot ID: P14138
  ENST ID: ENST00000337938
  CDS Start-End: 387-1103
cgctgtcctgggtgcgcctcgggccgctgcgctcctggccagctccccccagcgcctgggaggcgacccccagtgcgcccgggttcaaaggcccggcgaggcagttccagcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcagtaattcaaggacggcagaaaaaacagacaaagaagaggaagggaaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagcatcctggtctcgggaggcttctgtcattgctcacacacagttcagatttccacctctttatagacaagaagtgaatttgcctggggcagaacacccacccaaagagtccccacttaacaataccccccccccacggcaagaatgcccaaatccgaatgaccccagttttcctaatgagtaaaatgatcccagatgtgccccagagcatgacgcctgcagctccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgctctga

SEQ ID NO: 129810 - DNA, 1153 bp, Homo sapiens
  Payload ID: 5395
  Gene Symbol: EDN3
  Gene Name: endothelin 3
  ENST ID: ENST00000371025
  CDS Start-End: 196-774
gatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagcatcctggtctcgggaggcttctgtcattgctcacacacagttcagatttccacctctttatagacaagaagtgaatttgcctggggcagaacacccacccaaagagtccccacttaacaataccccccccccacggcaagaatgcccaaatccgaatgaccccagttttcctaatgagtaaaatgatcccagatgtgccccagagcatgacgcctgcagctccggtttcatgcaggaaattggttttggagagttttggcaagttggaaa

SEQ ID NO: 129811 - DNA, 2397 bp, Homo sapiens
  Payload ID: 5395
  Gene Symbol: EDN3
  Gene Name: endothelin 3
  Uniprot ID: P14138
  ENST ID: ENST00000371028
  CDS Start-End: 370-1086
ctcgggccgctgcgctcctggccagctccccccagcgcctgggaggcgacccccagtgcgcccgggttcaaaggcccggcgaggcagttccagcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcagtaattcaaggacggcagaaaaaacagacaaagaagaggaagggaaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcactccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgctctg

SEQ ID NO: 129812 - DNA, 2318 bp, Homo sapiens
  Payload ID: 5395
  Gene Symbol: EDN3
  Gene Name: endothelin 3
  Uniprot ID: P14138
  ENST ID: ENST00000395654
  CDS Start-End: 111-785
cgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcagacaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagcatcctggtctcgggaggcttctgtcattgctcacacacagttcagatttccacctctttatagacaagaagtgaatttgcctggggcagaacacccacccaaagagtccccacttaacaataccccccccccacggcaagaatgcccaaatccgaatgaccccagttttcctaatgagtaaaatgatcccagatgtgccccagagcatgacgcctgcagctccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgctctga

SEQ ID NO: 129813 - DNA, 2381 bp, Homo sapiens
  Payload ID: 5396
  Gene Symbol: ECE1
  Gene Name: endothelin converting enzyme 1
  Uniprot ID: P42892
  ENST ID: ENST00000264205
  CDS Start-End: 60-2363
ggggcgcggcggcggcggcgccagggtcggggccgcttccccattcgggcgcgagagccatggaggcgctgagggagtccgtgctgcatttggccttgcagatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagc

SEQ ID NO: 129814 - DNA, 3763 bp, Homo sapiens
  Payload ID: 5396
  Gene Symbol: ECE1
  Gene Name: endothelin converting enzyme 1
  Uniprot ID: P42892
  ENST ID: ENST00000357071
  CDS Start-End: 116-2392
gactctctgatgtttgggagcagatccgagcagctgagcagggtggctgttcctttcctggattagggctgaatctgtgggaaccagaccacccctgagacaggaggcagccctgatgcctctccagggcctgggcctgcagcggaaccccttcctccaagggaagcggggcccggggctcacgtcttccccgcccctcctgcctccttccctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaaca

SEQ ID NO: 129815 - DNA, 2484 bp, Homo sapiens
  Payload ID: 5396
  Gene Symbol: ECE1
  Gene Name: endothelin converting enzyme 1
  Uniprot ID: P42892
  ENST ID: ENST00000374893
  CDS Start-End: 76-2388
aggtggtgcaacgcctggcccggcccatcccatcccggccacccgggcagcgggaccaggcgtctggggcacagcatgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacc

SEQ ID NO: 129816 - DNA, 2328 bp, Homo sapiens
  Payload ID: 5396
  Gene Symbol: ECE1
  Gene Name: endothelin converting enzyme 1
  ENST ID: ENST00000436918
  CDS Start-End: 51-2267
catcccatcccggccacccgggcagcgggaccaggcgtctggggcacagcatgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatcc

SEQ ID NO: 129817 - DNA, 5099 bp, Homo sapiens
  Payload ID: 5396
  Gene Symbol: ECE1
  Gene Name: endothelin converting enzyme 1
  Uniprot ID: P42892
  ENST ID: ENST00000415912
  CDS Start-End: 127-2391
gagcgcgccgcctgggccaggcagccgagccgtccgagcagctgggctgggagcagggaacccggagctgggaatcgggagccgggcgcggggagctgcgcgaagccggggcggagcacgcgagctatgatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggagggc

SEQ ID NO: 129818 - DNA, 674 bp, Homo sapiens
  Payload ID: 5396
  Gene Symbol: ECE1
  Gene Name: endothelin converting enzyme 1
  ENST ID: ENST00000473505
  CDS Start-End: 444-674
gtttagctagactgttaggctggagggatttttcctccctttcaggacctgaatggagctatttctccttgcatctctgccaacatctcccaggatccacctctgatccactggtgggctcgggcatcaacagctttgggttccaatcccagctgtccccattcagctgggtggtgagaagccagggtctcacctctctggacctcagtttcctcacttgtaaaaagaaaaataacaaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatc

SEQ ID NO: 129819 - DNA, 580 bp, Homo sapiens
  Payload ID: 5396
  Gene Symbol: ECE1
  Gene Name: endothelin converting enzyme 1
  ENST ID: ENST00000527991
  CDS Start-End: 272-580
agattcaacccagatttctcctccacggctgcacagtgccaggaagggaactgagaagaccaaagtggaggttctttaccttccccaacacactcggggccaggcgtggcacccacaactgcaaatgagacaattagggagaataagtgctggctgccctgtcagcccagagcctcagtctgcccagggcacccagactctgtgaggttcccacctgaagaagcagttccatcttccacaaggagcacaggaccaagagtccaggacccagatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggac

SEQ ID NO: 129820 - DNA, 578 bp, Homo sapiens
  Payload ID: 5396
  Gene Symbol: ECE1
  Gene Name: endothelin converting enzyme 1
  ENST ID: ENST00000481130
  CDS Start-End: 175-578
aggacatcacacaggagcacaggagcatgaggaggtgcaggggcatctgtgggtagccctggagtcaggaccagctgctttctggtctgctttgcagtttgtgcttggagaagatcagagtggacaactcagccccttaaacccagctgggaggtgacacctgaagtcgtaaggatggagcagatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggacctt

SEQ ID NO: 129821 - DNA, 1823 bp, Homo sapiens
  Payload ID: 5397
  Gene Symbol: ECE2
  Gene Name: endothelin converting enzyme 2
  Uniprot ID: O60344
  ENST ID: ENST00000324557
  CDS Start-End: 46-813
attggctgaagggccggcggctctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgccatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagacctcccacctcaccttgcttccttcaggactcagatcatgaggacttccttagtgccattcagctctgaggccagagcatggtcctccacccttcctgccattctgccctgggctcctcaggtagttggaattcctgacttaggacttggggttgggtccaaggtgcttacatcccaggggcctcatgcctaagatagagggtgggagcgaacccacatgaaccaatacagcccagctccaactagatccagattccaggtttcttgcttctttcttgggttcctcagttctctcctgggttccccaacctcctctgccaccacaccaaaccaccagtgatgcatcccctggggcaaagctcatcataacccctctgcacaccagccagcctggagaccgttgttcctggggcctgttactgatcctcatctagccttgatttatccacaggagactgcaggctttgaacctagattgctttatgtttctcaccctagctccatccccaacactggtgaccagtcacgcctgggttgtatctctacccaaggaggccacatcataatgaggttcccaggccagcctggcctgtctgtcttacttggcaaccgtccctcaccagcaacatgcacctgagattcccaagtacctgccccccctcccattttggcctggctcctgagacctaagcagcggccacacacacacagagggggtctgtgtttattcacacactcctggtacagtgaggatggaggaacatttacgaagggcacccctgggttgagaacatctccggggccacagatgtcatccaaaggttcagagcagtccccatttgggttcccaggggcaagacgcaggggtccaaggtaaaatcggatctgggcccttggaaggtgatgataccttggggagaaggggtctgccagaaagcctcctggggtcaggcctgggcagactggccatgtggttggtaaccgtgtcgggggcttgtctcatcccagcctcaacacccatcctatctgccaggcgcagaagagcgtggccgagactgaggggagggcaggaaccatga

SEQ ID NO: 129822 - DNA, 2667 bp, Homo sapiens
  Payload ID: 5397
  Gene Symbol: ECE2
  Gene Name: endothelin converting enzyme 2
  Uniprot ID: O60344
  ENST ID: ENST00000357474
  CDS Start-End: 120-2555
ggtgctgcgcggcggccgtgatggctggtgacggcggggccgggcaggggaccggggccgcggcccgggagcgggccagctgccgggagccctgaatcaccgcctggcccgactccaccatgaacgtcgcgctgcaggagctgggagctggcagcaacatggtggagtacaaacgggccacgcttcgggatgaagacgcacccgagacccccgtagagggcggggcctccccggacgccatggaggtgggcaagggggcttcccctttctcaccaggccccagccctggcatgacgcctggcacacccaggagctctgggctgttctggagggtcacctgcccccacctccgctccatctctggcctctgctctaggactatggtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgccgactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccggcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtacgaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatggccagctgtcaccagacctggggcagctctcctgacaaagctgtttgctcttgggttgggaggaagcaaatgcaagctgggctgggtctag

SEQ ID NO: 129823 - DNA, 3147 bp, Homo sapiens
  Payload ID: 5397
  Gene Symbol: ECE2
  Gene Name: endothelin converting enzyme 2
  Uniprot ID: O60344
  ENST ID: ENST00000359140
  CDS Start-End: 144-2354
ggggggcggccgcggccgagcgggggtgctgcgcggcggccgtgatggctggtgacggcggggccgggcaggggaccggggccgcggcccgggagcgggccagctgccgggagccctgaatcaccgcctggcccgactccaccatgaacgtcgcgctgcaggagctgggagctggcagcaacgtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgccgactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccggcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtacgaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatggccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcccccaccattcactgtgacatctttccgtgtcaccctgcctggaagaggtctgggtggggaggccagttcccataggaaggagtctgcctcttctgtccccaggctcactcagcctggcggccatggggcctgccgtgcctgccccactgtgacccacaggcctgggtggtgtacctcctggacttctccccaggctcactcagtgcgcacttaggggtggactcagctctgtctggctcaccctcacgggctacccccacctcaccctgtgctccttgtgccactgctcccagtgctgctgctgaccttcactgacagctcctagtggaagcccaagggcctctgaaagcctcctgctgcccactgtttccctgggctgagaggggaagtgcatatgtgtagcgggtactggttcctgtgtcttagggcacaagccttagcaaatgattgattctccctggacaaagcaggaaagcagatagagcagggaaaaggaagaacagagtttatttttacagaaaagagggtgggagggtgtggtcttggcccttataggaccctgtgccaataaacagacatgcatccgtca

SEQ ID NO: 129824 - DNA, 3445 bp, Homo sapiens
  Payload ID: 5397
  Gene Symbol: ECE2
  Gene Name: endothelin converting enzyme 2
  Uniprot ID: O60344
  ENST ID: ENST00000402825
  CDS Start-End: 1-2652
atggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgccatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgccgactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccggcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtacgaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatggccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcccccaccattcactgtgacatctttccgtgtcaccctgcctggaagaggtctgggtggggaggccagttcccataggaaggagtctgcctcttctgtccccaggctcactcagcctggcggccatggggcctgccgtgcctgccccactgtgacccacaggcctgggtggtgtacctcctggacttctccccaggctcactcagtgcgcacttaggggtggactcagctctgtctggctcaccctcacgggctacccccacctcaccctgtgctccttgtgccactgctcccagtgctgctgctgaccttcactgacagctcctagtggaagcccaagggcctctgaaagcctcctgctgcccactgtttccctgggctgagaggggaagtgcatatgtgtagcgggtactggttcctgtgtcttagggcacaagccttagcaaatgattgattctccctggacaaagcaggaaagcagatagagcagggaaaaggaagaacagagtttatttttacagaaaagagggtgggagggtgtggtcttggcccttataggaccctgtgccaataaacagacatgcatccgtca

SEQ ID NO: 129825 - DNA, 3229 bp, Homo sapiens
  Payload ID: 5397
  Gene Symbol: ECE2
  Gene Name: endothelin converting enzyme 2
  Uniprot ID: O60344
  ENST ID: ENST00000404464
  CDS Start-End: 139-2436
gcggccgcggccgagcgggggtgctgcgcggcggccgtgatggctggtgacggcggggccgggcaggggaccggggccgcggcccgggagcgggccagctgccgggagccctgaatcaccgcctggcccgactccaccatgaacgtcgcgctgcaggagctgggagctggcagcaacatggtggagtacaaacgggccacgcttcgggatgaagacgcacccgagacccccgtagagggcggggcctccccggacgccatggaggtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgccgactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccggcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtacgaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatggccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcccccaccattcactgtgacatctttccgtgtcaccctgcctggaagaggtctgggtggggaggccagttcccataggaaggagtctgcctcttctgtccccaggctcactcagcctggcggccatggggcctgccgtgcctgccccactgtgacccacaggcctgggtggtgtacctcctggacttctccccaggctcactcagtgcgcacttaggggtggactcagctctgtctggctcaccctcacgggctacccccacctcaccctgtgctccttgtgccactgctcccagtgctgctgctgaccttcactgacagctcctagtggaagcccaagggcctctgaaagcctcctgctgcccactgtttccctgggctgagaggggaagtgcatatgtgtagcgggtactggttcctgtgtcttagggcacaagccttagcaaatgattgattctccctggacaaagcaggaaagcagatagagcagggaaaaggaagaacagagtttatttttacagaaaagagggtgggagggtgtggtcttggcccttataggaccctgtgccaataaacagacatgcatccgtca

SEQ ID NO: 129826 - DNA, 588 bp, Homo sapiens
  Payload ID: 5397
  Gene Symbol: ECE2
  Gene Name: endothelin converting enzyme 2
  ENST ID: ENST00000422932
  CDS Start-End: 1-204
atgaacgtcgcgctgcaggagctgggagctggcagcaacgtgggattccagaaggggacaagacagctgttaggctcacgcacgcagctggagctggtcttagcaggtgcctctctactgctggctgcactgcttctgggctgccttgtggccctaggggtccagtaccacagagagtttgcctcttccagacagacagactgacagtctcctaccctccggccatgttccctaccacagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtg

SEQ ID NO: 129827 - DNA, 2588 bp, Homo sapiens
  Payload ID: 5397
  Gene Symbol: ECE2
  Gene Name: endothelin converting enzyme 2
  ENST ID: ENST00000430587
  CDS Start-End: 1-2151
agccctggcatgacgcctggcacacccaggagctctgggctgttctggagggtcacctgcccccacctccgctccatctctggcctctgctctaggactatggtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgccgactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccggcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtacgaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtatcaccctctcggaaggcctggggtctgcccctttgtcctgctccctcctgagtatgtcattaggagaactctggggcacgtgtcaaacgggctggtgaatggggctgaggctggggcatgaaaggtgggctgggaaggcccatgcccagagcctccggccagccagggcccacaaaggcagcctgaagaggcctgagcgggagaatgccttggtaggatttcgcatagttcaaagggcaaggttgtcgtgcttgcggggcacagggtggcgaagggggcaaacgttcatcctcacgctgttcctgtgagggagacatgcaggaaacgaaagctcgggacgcagagtggcctgtccagggctgcccaggaatagagtaagtggcagagcaaggacccaggcagagcctccgctgggcagccacagcaggcagcttctggggctccgctttttcccctcgtcatgtccatgctgggcaacccgatgtcca

SEQ ID NO: 129828 - DNA, 2865 bp, Homo sapiens
  Payload ID: 5398
  Gene Symbol: ECEL1
  Gene Name: endothelin converting enzyme-like 1
  Uniprot ID: O95672
  ENST ID: ENST00000304546
  CDS Start-End: 212-2539
ggcggcgggcgctgggagacaccggacgcccgctcggctgcgctgcggctcaggcccccgctcgggcccgacccgctcggtcaccgccggctcgggcgcgcacctgccggctgcggccccagggccatgcggaggcccacgaggaggccggcggccacgcgcatcccgtagcccaggtggcccaggtctgcaccgcggcggcctcggcgccatggagcccccgtattcgctgacggcgcactacgatgagttccaagaggtcaagtacgtgagccgctgcggcgcggggggcgcgcgcggggcctccctgcccccgggcttcccgttgggcgctgcgcgcagcgccaccggggcccggtccgggctgccgcgctggaaccggcgcgaggtgtgcctgctgtcggggctggtgttcgccgccggcctctgcgccattctggcggctatgctggccctcaagtacctgggcccggtcgcggccggcggcggcgcctgtcccgagggctgccctgagcgcaaggccttcgcgcgcgccgctcgcttcctggccgccaacctggacgccagcatcgacccatgccaggacttctactcgttcgcctgcggcggttggctgcggcgccacgccatccccgacgacaagctcacctatggcaccatcgcggccatcggcgagcaaaacgaggagcgcctacggcgcctgctggcgcggcccgggggtgggcctggcggcgcggcccagcgcaaggtgcgcgccttcttccgctcgtgcctcgacatgcgcgagatcgagcgactgggcccgcgacccatgctagaggtcatcgaggactgcgggggctgggacctgggcggcgcggaggagcgtccgggggtcgcggcgcgatgggacctcaaccggctgctgtacaaggcgcagggcgtgtacagcgccgccgcgctcttctcgctcacggtcagcctggacgacaggaactcctcgcgctacgtcatccgcattgaccaggatgggctcaccctgccagagaggaccctgtacctcgctcaggatgaggacagtgagaagatcctggcagcatacagggtgttcatggagcgagtgctcagcctcctgggtgcagacgctgtggaacagaaggcccaagagatcctgcaagtggagcagcagctggccaacatcactgtgtcagagcatgacgacctacggcgagatgtcagctccatgtacaacaaggtgacgctggggcagctgcagaagatcaccccccacttgcggtggaagtggctgctagaccagatcttccaggaggacttctcagaggaagaggaggtggtgctgctggcgacagactacatgcagcaggtgtcgcagctcatccgctccacaccccaccgggtcctgcacaactacctggtgtggcgcgtggtggtggtcctgagtgaacacctgtccccgccattccgtgaggcactgcacgagctggcacaggagatggagggcagcgacaagccacaggagctggcccgggtctgcttgggccaggccaatcgccactttggcatggcgcttggcgccctctttgtacatgagcacttctcagctgccagcaaagccaaggtgcagcagctagtggaagacatcaagtacatcctgggccagcgcctggaggagctggactggatggacgccgagaccagggctgctgctcgggccaagctccagtacatgatggtgatggtcggctacccggacttcctgctgaaacccgatgctgtggacaaggagtatgagtttgaggtccatgagaagacctacttcaagaacatcttgaacagcatccgcttcagcatccagctctcagttaagaagattcggcaggaggtggacaagtccacgtggctgctccccccacaggcgctcaatgcctactatctacccaacaagaaccagatggtgttccccgcgggcatcctgcagcccaccctgtacgaccctgacttcccacagtctctcaactacgggggcatcggcaccatcattggacatgagctgacccacggctacgacgactgggggggccagtatgaccgctcagggaacctgctgcactggtggacggaggcctcctacagccgcttcctgcgaaaggctgagtgcatcgtccgtctctatgacaacttcactgtctacaaccagcgggtgaacgggaaacacacgcttggggagaacatcgcagatatgggcggcctcaagctggcctaccacgcctatcagaagtgggtgcgggagcacggcccagagcacccacttccccggctcaagtacacacatgaccagctcttcttcattgcctttgcccagaactggtgcatcaagcggcggtcgcagtccatctacctgcaggtgctgactgacaagcatgcccctgagcactacagggtgctgggcagtgtgtcccagtttgaggagtttggccgggctttccactgtcccaaggactcacccatgaaccctgcccacaagtgttccgtgtggtgagcctggctgcccgcctgcacgcccccactgcccccgcacgaatcacctcctgctggctaccggggcaggcatgcacccggtgccagccccgctctgggcaccacctgccttccagcccctccaggacccggtccccctgctgcccctcacttcaggaggggcctggagcagggtgaggctggactttggggggctgtgagggaaatatactggggtccccagattctgctctaagggggccagaccctctgccaggctggattgtacgggccccaccttcgctgtgttcttgctgcaaagtctggtcaataaatcactgcactgtt

SEQ ID NO: 129829 - DNA, 2322 bp, Homo sapiens
  Payload ID: 5398
  Gene Symbol: ECEL1
  Gene Name: endothelin converting enzyme-like 1
  Uniprot ID: O95672
  ENST ID: ENST00000409941
  CDS Start-End: 1-2322
atggagcccccgtattcgctgacggcgcactacgatgagttccaagaggtcaagtacgtgagccgctgcggcgcggggggcgcgcgcggggcctccctgcccccgggcttcccgttgggcgctgcgcgcagcgccaccggggcccggtccgggctgccgcgctggaaccggcgcgaggtgtgcctgctgtcggggctggtgttcgccgccggcctctgcgccattctggcggctatgctggccctcaagtacctgggcccggtcgcggccggcggcggcgcctgtcccgagggctgccctgagcgcaaggccttcgcgcgcgccgctcgcttcctggccgccaacctggacgccagcatcgacccatgccaggacttctactcgttcgcctgcggcggttggctgcggcgccacgccatccccgacgacaagctcacctatggcaccatcgcggccatcggcgagcaaaacgaggagcgcctacggcgcctgctggcgcggcccgggggtgggcctggcggcgcggcccagcgcaaggtgcgcgccttcttccgctcgtgcctcgacatgcgcgagatcgagcgactgggcccgcgacccatgctagaggtcatcgaggactgcgggggctgggacctgggcggcgcggaggagcgtccgggggtcgcggcgcgatgggacctcaaccggctgctgtacaaggcgcagggcgtgtacagcgccgccgcgctcttctcgctcacggtcagcctggacgacaggaactcctcgcgctacgtcatccgcattgaccaggatgggctcaccctgccagagaggaccctgtacctcgctcaggatgaggacagtgagaagatcctggcagcatacagggtgttcatggagcgagtgctcagcctcctgggtgcagacgctgtggaacagaaggcccaagagatcctgcaagtggagcagcagctggccaacatcactgtgtcagagcatgacgacctacggcgagatgtcagctccatgtacaacaaggtgacgctggggcagctgcagaagatcaccccccacttgcggtggaagtggctgctagaccagatcttccaggaggacttctcagaggaagaggaggtggtgctgctggcgacagactacatgcagcaggtgtcgcagctcatccgctccacaccccaccgggtcctgcacaactacctggtgtggcgcgtggtggtggtcctgagtgaacacctgtccccgccattccgtgaggcactgcacgagctggcacaggagatggagggcagcgacaagccacaggagctggcccgggtctgcttgggccaggccaatcgccactttggcatggcgcttggcgccctctttgtacatgagcacttctcagctgccagcaaagccaaggtgcagcagctagtggaagacatcaagtacatcctgggccagcgcctggaggagctggactggatggacgccgagaccagggctgctgctcgggccaagctccagtacatgatggtgatggtcggctacccggacttcctgctgaaacccgatgctgtggacaaggagtatgagtttgaggtccatgagaagacctacttcaagaacatcttgaacagcatccgcttcagcatccagctctcagttaagaagattcggcaggaggtggacaagtggctgctccccccacaggcgctcaatgcctactatctacccaacaagaaccagatggtgttccccgcgggcatcctgcagcccaccctgtacgaccctgacttcccacagtctctcaactacgggggcatcggcaccatcattggacatgagctgacccacggctacgacgactgggggggccagtatgaccgctcagggaacctgctgcactggtggacggaggcctcctacagccgcttcctgcgaaaggctgagtgcatcgtccgtctctatgacaacttcactgtctacaaccagcgggtgaacgggaaacacacgcttggggagaacatcgcagatatgggcggcctcaagctggcctaccacgcctatcagaagtgggtgcgggagcacggcccagagcacccacttccccggctcaagtacacacatgaccagctcttcttcattgcctttgcccagaactggtgcatcaagcggcggtcgcagtccatctacctgcaggtgctgactgacaagcatgcccctgagcactacagggtgctgggcagtgtgtcccagtttgaggagtttggccgggctttccactgtcccaaggactcacccatgaaccctgcccacaagtgttccgtgtggtga

SEQ ID NO: 129830 - DNA, 833 bp, Homo sapiens
  Payload ID: 5398
  Gene Symbol: ECEL1
  Gene Name: endothelin converting enzyme-like 1
  ENST ID: ENST00000411860
  CDS Start-End: 1-507
ggcatcctgcagcccaccctgtacgaccctgacttcccacagtctctcaactacgggggcatcggcaccatcattggacatgagctgacccacggctacgacgactgggggggccagtatgaccgctcagggaacctgctgcactggtggacggaggcctcctacagccgcttcctgcgaaaggctgagtgcatcgtccgtctctatgacaacttcactgtctacaaccagcgggcctatcagaagtgggtgcgggagcacggcccagagcacccacttccccggctcaagtacacacatgaccagctcttcttcattgcctttgcccagaactggtgcatcaagcggcggtcgcagtccatctacctgcaggtgctgactgacaagcatgcccctgagcactacagggtgctgggcagtgtgtcccagtttgaggagtttggccgggctttccactgtcccaaggactcacccatgaaccctgcccacaagtgttccgtgtggtgagcctggctgcccgcctgcacgcccccactgcccccgcacgaatcacctcctgctggctaccggggcaggcatgcacccggtgccagccccgctctgggcaccacctgccttccagcccctccaggacccggtccccctgctgcccctcacttcaggaggggcctggagcagggtgaggctggactttggggggctgtgagggaaatatactggggtccccagattctgctctaagggggccagaccctctgccaggctggattgtacgggccccaccttcgctgtgttcttgctgcaaagtctggtcaataaatcactgcactgtt

SEQ ID NO: 129831 - DNA, 4135 bp, Homo sapiens
  Payload ID: 5399
  Gene Symbol: EDNRA
  Gene Name: endothelin receptor type A
  Uniprot ID: P25101
  ENST ID: ENST00000324300
  CDS Start-End: 516-1799
gtgctttttagtggccgcgtcccaggatagctggaaggttaggacgctcttgcggtcccagagtggagtggaaggtctggagctttgggaggagacggggaggacagactggaggcgtgttcctccggagttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaggttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtgaaaaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtattttttaactgcataatagcctaacatgattatttgaacttatttacacatagtttgaaaaaaaaaagacaaaaatagtattcaggtgagcaattagattagtattttccacgtcactgtttatttttttaaaacacaaattctaaagctacaacaaatactacaggcccttaaagcacagtctgatgacacatttggcagtttaatagatgttactcaaagaattttttaagaactgtattttattttttaaatggtgttttattacaagggaccttgaacatgttttgtatgttaaattcaaaagtaatgcttcaatcagatagttctttttcacaagttcaatctgtttttcatgtaaattttgtatgaaaaatcaatgtcaagtaccaaaatgttaatgtatgtgtcatttaactctgcctgagactttcagtgcactgtatatagaagtctaaaacacacctaagagaaaaagatcgaatttttcagatgattcagaaattttcattcaggtatttgtaatagtgacatatatatgtatatacatatcacctcctattctcttaatttttcttaaaatgttaactggcagtaagtcttttttgatcattcccttttccatataggaaacataattttgaagtggccagatgagtttatcatgtcagtgaaaaataattacccacaaatgccaccagaacttacgattcttcacttcttggggttttcagtatgaacctaactccccaccccaacatctccctcccacattgtcaccatttcaaagggcccacagtgacttttgctgggcattttcccagatgtttacagactgtgagtacagcagaaaatcttttactagtgtgtgtgtgtatatatataaacaattgtaaatttcttttagcccatttttctagactgtctctgtggaatatatttgtgtgtgtgatatatgcatgtgtgtgatggtatgtatggatttaatctaatctaataattgtgccccgcagttgtgccaaagtgcatagtctgagtaaaatctaggtgattgttcatcatgacaacctgcctcagtccattttaacctgtagcaaccttctgcattcataaatcttgtaatcatgttaccattacaaatgggatataagaggcagcgtgaaagcagatgagctgtggactagcaatatagggttttgtttggttggttggtttgataaagcagtatttggggtcatattgtttcctgtgctggagcaaaagtcattacactttgaagtattatattgttcttatcctcaattcaatgtggtgatgaaattgccaggttgtctgatatttctttcagacttcgccagacagattgctgataataaattaggtaagataatttgttgggccatattttaggacaggtaaaataacatcaggttccagttgcttgaattgcaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtaactgtggtttactagcaggaatatttccaatttctacctttactacatcttttcaacaagtaactttgtagaaatgagccagaagccaaggccctgagttggcagtggcccataagtgtaaaataaaagtttacagaaaccttg

SEQ ID NO: 129832 - DNA, 3823 bp, Homo sapiens
  Payload ID: 5399
  Gene Symbol: EDNRA
  Gene Name: endothelin receptor type A
  Uniprot ID: P25101
  ENST ID: ENST00000358556
  CDS Start-End: 531-1487
gggggcggcagctttgtgctttttagtggccgcgtcccaggatagctggaaggttaggacgctcttgcggtcccagagtggagtggaaggtctggagctttgggaggagacggggaggacagactggaggcgtgttcctccggagttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaggttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtgaaaaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtattttttaactgcataatagcctaacatgattatttgaacttatttacacatagtttgaaaaaaaaaagacaaaaatagtattcaggtgagcaattagattagtattttccacgtcactgtttatttttttaaaacacaaattctaaagctacaacaaatactacaggcccttaaagcacagtctgatgacacatttggcagtttaatagatgttactcaaagaattttttaagaactgtattttattttttaaatggtgttttattacaagggaccttgaacatgttttgtatgttaaattcaaaagtaatgcttcaatcagatagttctttttcacaagttcaatctgtttttcatgtaaattttgtatgaaaaatcaatgtcaagtaccaaaatgttaatgtatgtgtcatttaactctgcctgagactttcagtgcactgtatatagaagtctaaaacacacctaagagaaaaagatcgaatttttcagatgattcagaaattttcattcaggtatttgtaatagtgacatatatatgtatatacatatcacctcctattctcttaatttttcttaaaatgttaactggcagtaagtcttttttgatcattcccttttccatataggaaacataattttgaagtggccagatgagtttatcatgtcagtgaaaaataattacccacaaatgccaccagaacttacgattcttcacttcttggggttttcagtatgaacctaactccccaccccaacatctccctcccacattgtcaccatttcaaagggcccacagtgacttttgctgggcattttcccagatgtttacagactgtgagtacagcagaaaatcttttactagtgtgtgtgtgtatatatataaacaattgtaaatttcttttagcccatttttctagactgtctctgtggaatatatttgtgtgtgtgatatatgcatgtgtgtgatggtatgtatggatttaatctaatctaataattgtgccccgcagttgtgccaaagtgcatagtctgagtaaaatctaggtgattgttcatcatgacaacctgcctcagtccattttaacctgtagcaaccttctgcattcataaatcttgtaatcatgttaccattacaaatgggatataagaggcagcgtgaaagcagatgagctgtggactagcaatatagggttttgtttggttggttggtttgataaagcagtatttggggtcatattgtttcctgtgctggagcaaaagtcattacactttgaagtattatattgttcttatcctcaattcaatgtggtgatgaaattgccaggttgtctgatatttctttcagacttcgccagacagattgctgataataaattaggtaagataatttgttgggccatattttaggacaggtaaaataacatcaggttccagttgcttgaattgcaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtaactgtggtttactagcaggaatatttccaatttctacctttactacatcttttcaacaagtaactttgtagaaatgagccagaagccaaggccctgagttggcagtggcccataagtgtaaaataaaagtttacagaaaccttg

SEQ ID NO: 129833 - DNA, 1032 bp, Homo sapiens
  Payload ID: 5399
  Gene Symbol: EDNRA
  Gene Name: endothelin receptor type A
  Uniprot ID: P25101
  ENST ID: ENST00000506066
  CDS Start-End: 1-957
atggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgg

SEQ ID NO: 129834 - DNA, 1569 bp, Homo sapiens
  Payload ID: 5399
  Gene Symbol: EDNRA
  Gene Name: endothelin receptor type A
  Uniprot ID: P25101
  ENST ID: ENST00000511804
  CDS Start-End: 701-1309
gtgctttttagtggccgcgtcccaggatagctggaaggttaggacgctcttgcggtcccagagtggagtggaaggtctggagctttgggaggagacggggaggacagactggaggcgtgttcctccggagttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaggttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacgctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggag

SEQ ID NO: 129835 - DNA, 1160 bp, Homo sapiens
  Payload ID: 5399
  Gene Symbol: EDNRA
  Gene Name: endothelin receptor type A
  Uniprot ID: P25101
  ENST ID: ENST00000510697
  CDS Start-End: 1-564
atggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgg

SEQ ID NO: 129836 - DNA, 4277 bp, Homo sapiens
  Payload ID: 5400
  Gene Symbol: EDNRB
  Gene Name: endothelin receptor type B
  Uniprot ID: P24530
  ENST ID: ENST00000334286
  CDS Start-End: 238-1566
atcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctctgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccttttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctgg

SEQ ID NO: 129837 - DNA, 4471 bp, Homo sapiens
  Payload ID: 5400
  Gene Symbol: EDNRB
  Gene Name: endothelin receptor type B
  Uniprot ID: P24530
  ENST ID: ENST00000377211
  CDS Start-End: 154-1752
aaacagccttttgggacctgtccccggacgaggactgcccccctccctcgggcaactactactgatgctgtccaggcatcgcccaaggggaaaggttgcagcggggtcggaaggcgcgggaggagtctggcggtgattgatgggaagggatgaatgaataaaagtacttgtctgatggcagcagagaccccgagcaaacggtggaggctacactgtctggcattctcgcagcgtttcgtcagagccggacccgcctgcagctcaagggaggcgtgctcctctcccagagcaggctggaacccagctgggttccgcctcccgggaaggtggtctccattcgtcgctctgcatctggtttgtcagatccgagaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctctgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccttttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctggg

SEQ ID NO: 129838 - DNA, 1571 bp, Homo sapiens
  Payload ID: 5400
  Gene Symbol: EDNRB
  Gene Name: endothelin receptor type B
  Uniprot ID: P24530
  ENST ID: ENST00000626030
  CDS Start-End: 227-1537
gtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctctgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaaggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcac

SEQ ID NO: 129839 - DNA, 643 bp, Homo sapiens
  Payload ID: 5400
  Gene Symbol: EDNRB
  Gene Name: endothelin receptor type B
  ENST ID: ENST00000475537
  CDS Start-End: 409-643
attgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggtatagaggttcccctgcggggcaaaatgcagagcttgacacaagcccttggcctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcag

SEQ ID NO: 129840 - DNA, 1082 bp, Homo sapiens
  Payload ID: 5401
  Gene Symbol: ENHO
  Gene Name: energy homeostasis associated
  Uniprot ID: Q6UWT2
  ENST ID: ENST00000399775
  CDS Start-End: 427-657
gcggccgcggaggaggtgcggccccaaggggaggaggtgcccgctcaccgcagaccgcccgcggcagaggccgccccggtcgcgccgcggcgggagcggccggtggaggctgcgcggccgagggggagggccgggggagcggacgtcgcctctgctggtctcccacctcccgccgccccccgcccgcaggctcccaagccttagtcggcgccgagcatcccgctgccccggaccctcccgcgggcgcgcaccaggctcaactcaggctcaggactgcaggtagacatctccactgcccaggaatcactgagcgtgcagacagcacagcctcctctgaaggccggccataccagagtcctgcctcggcatgggcctcaccattgaggcagctccactgtctgtgctggtctgagggtgctgcctgtcatgggggcagccatctcccagggggccctcatcgccatcgtctgcaacggtctcgtgggcttcttgctgctgctgctctgggtcatcctctgctgggcctgccattctcgctctgccgacgttgactctctctctgaatccagtcccaactccagccctggcccctgtcctgagaaggccccaccaccccagaagcccagccatgaaggcagctacctgctgcagccctgaaggcccctggcctagcctggagcccaggacctaagtccacctcacctagagcctggaattaggatcccagagttcagccagcctggggtccagaactcaagagtccgcctgcttggagctggacccagcggcccagagtctagccagcttggctccaataggagctcagtggccctaaggagatgggcctggggtgggggcttatgagttggtgctagagccagggccatctggactatgctccatcccaagggccaagggtcaggggccgggtccactctttccctaggctgagcacctctaggccctctaggctggggaagcaaactggaacccatggcaataataggagggtgtccaggctgggcccctcccctggtcctcccagtgtttgctggataataaatggaactatggctctaccc

SEQ ID NO: 129841 - DNA, 2457 bp, Homo sapiens
  Payload ID: 5402
  Gene Symbol: EN1
  Gene Name: engrailed homeobox 1
  Uniprot ID: Q05925
  ENST ID: ENST00000295206
  CDS Start-End: 512-1690
cgattaaaggcgctgccagcctcacgctctgggcacagctgagcgtgacactcggggaagtcaaacccctcactactgcctaggaagatggctagactttaaatactatttttttccctttaagaaaaaaattattggagctttttttcttgctttctttttccttttctttttctttttttccttcatttttttggccgtggcttactccccatttaaatcaaatcattgaatctggttgcagaaagaaaaaagaaatagccaagtgtctccatatctggatgtctacaaattagagagggagagacagcgagatctatctgctagataagaacgagcgatccaggccagacgcctgagcttttttcctgcacccgccccgtgccttcgctgaggcttcgcctgcctccttcctccgcgcacccccacgggccgctggcaaagtggggtggggagcgaggcggtgggggcgggggccggcgcggcggccggggcggcggggcggccgagcatggaagaacagcagccggaacctaaaagtcagcgcgactcggccctcggcgcggcggcggcggcgactccgggcggcctcagcctgagcctcagtccgggcgccagcggcagcagcggcagcggcagcgatggagacagcgtgccggtgtccccgcagcctgcgcccccctcgccgcccgcggcgccttgcctgccgcccctggcccaccacccgcacctccccccacaccccccgcccccgccgcctcagcatctcgcggcgcctgctcaccagccgcagccagcggcccagctgcaccgcaccaccaactttttcatcgacaacatcctgaggccggacttcggctgcaaaaaggagcagccgccaccgcagcttctggtggctgcggcggccagaggaggcgcaggaggaggaggccgggtcgagcgtgacagaggccagactgccgcaggtagagaccctgtccacccgttgggcacccgggcgccaggcgctgcctcgctcctgtgcgccccggacgcgaactgtggcccacccgacggctcccagccagccgccgccggcgcgggcgcgtctaaagctgggaacccggctgcggcggcggcggcggccgcggcggcagtggcggcggcggcggcggccgcagcagccaagccctcggacaccggtggcggcggcagtggaggcggcgcggggagccccggagcgcagggcaccaaatacccggagcacggcaacccggctatcctacttatgggctcagccaacggcgggcccgtggtcaaaactgactcgcagcagcctctcgtatggcccgcctgggtgtactgcacacgttattcggatcgtccatcctccggtccgcgcaccaggaagctgaagaagaagaagaacgagaaggaggacaagcggccgcggaccgcgttcacggccgagcagctgcagagactcaaggcggagttccaggcaaaccgctacatcacggagcagcggcggcagaccctggcccaggaactcagcctcaacgagtcccagatcaagatctggttccagaacaagcgcgccaagatcaagaaagccacaggcatcaagaacggcctggcgctgcacctcatggcccagggactgtacaaccactccaccaccacggtccaggacaaagacgagagcgagtagccgccacaggccggggccgcgcccgcgccccctcccggcaccgccgccgtcgtctcccggcccctcgctgggggagaaagcatctgctccaaggagggagggagcgcagggaaaagagcgagagagacagaaagagagcctcagaatggacaatgacgttgaaacgcagcatttttgaaaagggagaaagactcggacaggtgctatcgaaaaataagatccattctctattcccagtataagggacgaaactgcgaactccttaaagctctatctagccaaaccgcttacgaccttgtatatatttaatttcaggtaaggaaaacacatacgtgtagcgatctctatttgctggacatttttattaatctcctttattattattgttataattattataattattataattattttatcccctcccccaccgcctcgctgcccccgcccagtttcgttttcgttgcctttttcatttgaatgtcattgcttctccggtgcctcccgacccgcatcgccggccctggtttctctgggacttttctttgtgtgcgagagtgtgtttcctttcgtgtctgcccacctcttctcccccacctcccgggtcccttctgtcggtctgtctgttctgcccccctttcgttttccggagacttgttgagaaatacgaccccacagactgcgagactgaaccgccgctacaagccaaagattttattatgttcagaaacctgtagtctgaaataaagtgtacactgtgctcacga

SEQ ID NO: 129842 - DNA, 3395 bp, Homo sapiens
  Payload ID: 5403
  Gene Symbol: EN2
  Gene Name: engrailed homeobox 2
  Uniprot ID: P19622
  ENST ID: ENST00000297375
  CDS Start-End: 250-1251
tctctcatcgtctgggcgagcggggcggctcgtggtgtttctaacccagttcgtggattcaaaggtggctccgcgccgagcgcggccggcgacttgtaggacctcagccctggccgcggccgccgcgcacgccctcggaagactcggcggggtgggggcgcgggggtctccgtgtgcgccgcgggagggccgaaggctgatttggaagggcgtccccggagaaccagtgtgggatttactgtgaacagcatggaggagaatgaccccaagcctggcgaagcagcggcggcggtggagggacagcggcagccggaatccagccccggcggcggctcgggcggcggcggcggtagcagcccgggcgaagcggacaccgggcgccggcgggctctgatgctgcccgcggtcctgcaggcgcccggcaaccaccagcacccgcaccgcatcaccaacttcttcatcgacaacatcctgcggcccgagttcggccggcgaaaggacgcggggacctgctgtgcgggcgcgggaggaggaaggggcggcggagccggcggcgaaggcggcgcgagcggtgcggagggaggcggcggcgcgggcggctcggagcagctcttgggctcgggctcccgagagccccggcagaacccgccatgtgcgcccggcgcgggcgggccgctcccagccgccggcagcgactctccgggtgacggggaaggcggctccaagacgctctcgctgcacggtggcgccaagaaaggcggcgaccccggcggccccctggacgggtcgctcaaggcccgcggcttgggcggcggcgacctgtcggtgagctcggactcggacagctcgcaagccggcgccaacctgggcgcgcagcccatgctctggccggcgtgggtctactgtacgcgctactcggaccggccttcttcaggtcccaggtctcgaaaaccaaagaagaagaacccgaacaaagaggacaagcggccgcgcacggcctttaccgccgagcagctgcagaggctcaaggccgagttccagaccaacaggtacctgacggagcagcggcgccagagcctggcgcaggagctgagcctcaacgagtcacagatcaagatttggttccagaacaagcgcgccaagatcaagaaggccacgggcaacaagaacacgctggccgtgcacctcatggcacagggcttgtacaaccactccaccacagccaaggagggcaagtcggacagcgagtagggcggggggcatggaggccaggtctcagtccgcgctaaacaatgcaataatttaaaatcataaagggccagtgtataaagattataccagcattaatagtgaaaatattgtgtattagctaaggttctgaaatattctatgtatatatcatttacaggtggtataaaatccaaaatatctgactataaaatatttttttgagttttttgtgtttatgagattatgctaattttatgggtttttttcttttttgcgaagggggctgcttagggtttcacctttttttaatcccctaagctccattatatgacattggacacttttttattattccaaaagaagaaaaaattaaaacaacttgctgaagtccaaagattttttattgctgcatttcacacaactgtgaaccgaataaatagctcctatttggtctatgacttctgccactttgtttgtgttggcttggtgaggacagcaggaggggcccacacctcaagcctggaccagccacctcaaggccttggggagcttaggggacctggtgggagagaggggacttccagggtccttgggccagttctgggatttggccctgggaagcagcccagcgtaccccaggcctgctctgggaagtcggctccatgctcaccagcagccgcccaggcccgcagcctcacccggctccctctcctcaccctcctgcacctaactccctcctccttctcctttttcctcctcttcctccttcctccttcctcctgctcctcctttcttcttctttttcttctcctcctcctccttccttcctcctcctccttctctttcctcctcctcctcaccaagggcccaaccgtgtgcatacatcgtctgcgtctgtggtctgtgtcgctgtccccagtcccaccgcagtcctgccgcaggcctaaccctcctgccctgggcactgcctccatgcagaagcgcttcgaggttctggggctaaaggcctggggtgtgtggcctaaagcccaagagcggtggggcgaccctccttttggcttggccccaggaatttcctgtgactccaccagccatcatgggtgccagccagggtcccagaaatgaggccatggctcactgtttctgggcgggcagaaggctctgtagagggagatggcatcatctatcttcctttcctttttcttttcttccctatttttttctttttttcctttatttttttcttttcttggagtggctgcttctgctatagagaacattcttccaagataaatatgtgtgtttacacatatgtctgcatgcatgtgaacacacacacacacacacacacaccaggcgtgtttgagtccacagttctgaaacatgtggctaccttgtctttcaaaagaactcagaatcctccaggatctagaagaaggaagaaagtgtgtaaataatcatttcttatcatcactttttgtcttttcttgttttttaaaatatacattttatttttgaaggtgtggtacagtgtaaattaaatatattcaatatatttcccaccaagtacctatatatgtatataaacaaacacattatctatatataacgccacactgtcttctgtttagtgtatggggaaagaccaatccaactgtccatctgtggctgggacagcccagggggtgtgcccacggctgacccaggggtgtgcacacggctgagctgggagtcccgctggtctccctgaggactgagggtgaacttcgctctttgccttaaacctctttatttcattgcagtaatagttttacgttgtacataatagtgtaaacctttttaaaaaggaaagtataaaaacaaaagttgtaatttaaaagtctgaataaccatctgctgcttaggaaactcaatgaaatgacatgcctttttagcaggaagcaaagttggtttctgttttttgttttctttgttgttttagtttataaaacatgtgcattttacagttccagtatcaaatatttataatcttatgagaaatgaatgaatgtttctatttacaactgtgcttatcaaaattgtgaacacccccacccccgcatttttgtgtgttgaaattcttgaaggttacattaaataaaacaaaatctctttattataaaata

SEQ ID NO: 129843 - DNA, 4022 bp, Homo sapiens
  Payload ID: 5404
  Gene Symbol: ELMO1
  Gene Name: engulfment and cell motility 1
  Uniprot ID: Q92556
  ENST ID: ENST00000310758
  CDS Start-End: 649-2832
aattagtgcctccaaacgccgtgtgtgagctcatcgaagtcatgctctgcacacatattatttatagcagatctgaggcatgcatggtgtttgacatttctgtcttttaagtagggggacttcaaaaagtcgtgggcatccccctaggcaaagtgcagtgggcagggaccaggcagggtgcgggcgcaaggcgaacgcgcagaccacgagtgtcctggcgcaggtgccgggggcggcggctgcaactccgcagcgtccgctcgggaggagagttcgcggctgatctccggatgccttgcagatgcaaaatgtgtctctggccagcaggaggaaggaagaggaagtgagagcagcggcagccggcggtgcagcagccggccgacccagagtgtaagtgcgtgtgctggggcgagcgggagcgggcgaggatgggcacaggatagaggcagagccacccacgccgccgcggccccacgctgggcgacagagcctccagttccccttcaatggtggcgggtcgccggagctctgatcgccgggaacccttgccgctgctgtcctgcgaccccaagcaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttgctttggagacatgctgtccttcaccctgacggccttcgttgagctgatggaccatggcatagtgtcctgggatacattttcggtggcgttcattaagaagatagcaagttttgtgaacaagtcagccatagacatctcgatcctgcagcggtccttggccattttggagtcgatggtgctcaatagccatgacctctaccagaaagtggcgcaggagatcaccatcggccagctcattccacacctgcaagggtcagatcaagaaatccaaacctatactattgcagtgattaatgcgcttttcctgaaggctcctgatgagaggaggcaggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagtttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatga

SEQ ID NO: 129844 - DNA, 1982 bp, Homo sapiens
  Payload ID: 5404
  Gene Symbol: ELMO1
  Gene Name: engulfment and cell motility 1
  Uniprot ID: Q92556
  ENST ID: ENST00000396040
  CDS Start-End: 150-893
tggaggggcagcgtggggaacgagaaactctttgcctgtagggacccttctagctgcaaacttaaaaatgtatgtggcaagatgcaacccaagcaccgagcaggattccagacgagttataatcattctgaacggggagaggaaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagtttttttttttttttttgctttgtttttgtacaaaagagtctaacattttttgccaaacagatatatatttaatgaaaagaagagatacataaa

SEQ ID NO: 129845 - DNA, 2524 bp, Homo sapiens
  Payload ID: 5404
  Gene Symbol: ELMO1
  Gene Name: engulfment and cell motility 1
  Uniprot ID: Q92556
  ENST ID: ENST00000396045
  CDS Start-End: 591-1334
tgatgaatatgaactatctccagcccatcaccagctttttctttttcttcttgtccttatttgttttttagttctttataagaaaaagtgggggatatattgagaagtaccaagacggggagctatgggtttattgacaaaagagcataggacactaaaatagaaacgaagttattatttttctcttgtgatactctaagagaaaagctcttcctggaaaagccgatgatctctgaagatgctaaataaatgagcaggagtttccctgaaatggaggcgccctttgattggctgatctttccccgactcctgccaatcggagcatccctgggctccagctccataaacataagcaaagctacatgcttattcttctggacttggagtgtataccatttaaaggtgtgcggcgggtctctgttcacatggctcaactggaaacctgtttcatgaacaagcttactcaggaaccatctggtggtattccagcacattgttcttcagggggacgactctaagtcgctttgtggtggcagcagcttagaatcagtatttgtggttgggaaagatggacttacgggagcttggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagtttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatga

SEQ ID NO: 129846 - DNA, 503 bp, Homo sapiens
  Payload ID: 5404
  Gene Symbol: ELMO1
  Gene Name: engulfment and cell motility 1
  ENST ID: ENST00000453399
  CDS Start-End: 261-503
agatgcaaaatgtgtctctggccagcaggaggaaggaagaggaagtgagagcagcggcagccggcggtgcagcagccggccgacccagagtggggcagagcagggagcacttataccatacaaggcagagaagatacagatcaagatatgcccaaggcccttctagttcagcctctccttggagtaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctcca

SEQ ID NO: 129847 - DNA, 2621 bp, Homo sapiens
  Payload ID: 5404
  Gene Symbol: ELMO1
  Gene Name: engulfment and cell motility 1
  Uniprot ID: Q92556
  ENST ID: ENST00000448602
  CDS Start-End: 438-2621
gagctcatcgaagtcatgctctgcacacatattatttatagcagatctgaggcatgcatggtgtttgacatttctgtcttttaagtagggggacttcaaaaagtcgtgggcatccccctaggcaaagtgcagtgggcagggaccaggcagggtgcgggcgcaaggcgaacgcgcagaccacgagtgtcctggcgcaggtgccgggggcggcggctgcaactccgcagcgtccgctcgggaggagagttcgcggctgatctccggatgccttgcagatgcaaaatgtgtctctggccagcaggaggaaggaagaggaagtgagagcagcggcagccggcggtgcagcagccggccgacccagagtgtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttgctttggagacatgctgtccttcaccctgacggccttcgttgagctgatggaccatggcatagtgtcctgggatacattttcggtggcgttcattaagaagatagcaagttttgtgaacaagtcagccatagacatctcgatcctgcagcggtccttggccattttggagtcgatggtgctcaatagccatgacctctaccagaaagtggcgcaggagatcaccatcggccagctcattccacacctgcaagggtcagatcaagaaatccaaacctatactattgcagtgattaatgcgcttttcctgaaggctcctgatgagaggaggcaggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactga

SEQ ID NO: 129848 - DNA, 610 bp, Homo sapiens
  Payload ID: 5404
  Gene Symbol: ELMO1
  Gene Name: engulfment and cell motility 1
  ENST ID: ENST00000424212
  CDS Start-End: 1-375
caggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattgtaagtaagctatctccagtatgcgctctccctccagcctccccgggcctgacctcagccacataactgatgtctcttccgagcgtgtggtcctcttgcgctttacggaatagtttccacatttccagatgtttagctggtttaaacaggatcacatgaaaatctcttctggcttcagtgaaatggaataacttgcacaagtgtgactaatactgcatttgtttattcagttctgattaagtgtaaccgagagtagttagcccggaatgtatctcgacttcattaaatctatttcacaaga

SEQ ID NO: 129849 - DNA, 881 bp, Homo sapiens
  Payload ID: 5404
  Gene Symbol: ELMO1
  Gene Name: engulfment and cell motility 1
  ENST ID: ENST00000420636
  CDS Start-End: 1-549
gcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcatcacttatctcctgaaaaattcacactgccgtgaacacgatccagccttgcagtgtgtctcggagctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgatttt

SEQ ID NO: 129850 - DNA, 858 bp, Homo sapiens
  Payload ID: 5404
  Gene Symbol: ELMO1
  Gene Name: engulfment and cell motility 1
  ENST ID: ENST00000445322
  CDS Start-End: 682-858
atagcagatctgaggcatgcatggtgtttgacatttctgtcttttaagtagggggacttcaaaaagtcgtgggcatccccctaggcaaagtgcagtgggcagggaccaggcagggtgcgggcgcaaggcgaacgcgcagaccacgagtgtcctggcgcaggtgccgggggcggcggctgcaactccgcagcgtccgctcgggaggagagttcgcggctgatctccggatgccttgcagatgcaaaatgtgtctctggccagcaggaggaaggaagaggaagtgagagcagcggcagccggcggtgcagcagccggccgacccagagtgtaagtgcgtgtgctggggcgagcgggagcgggcgaggatgggcacaggatagaggcagagccacccacgccgccgcggccccacgctgggcgacagagcctccagttccccttcaatggtggcgggtcgccggagctctgatcgccgggaacccttgccgctgctgtcctgcgaccccaagcagggggcagagcagggagcacttataccatacaaggcagagaagatacagatcaagatatgcccaaggcccttctagttcagcctctccttggagtaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttc

SEQ ID NO: 129851 - DNA, 576 bp, Homo sapiens
  Payload ID: 5404
  Gene Symbol: ELMO1
  Gene Name: engulfment and cell motility 1
  ENST ID: ENST00000455119
  CDS Start-End: 74-576
gtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgactttggagacatgctgtccttcaccctgacggccttcgttgagctgatggaccatggcatagtgtcctgggatacattttcggtggcgtt

SEQ ID NO: 129852 - DNA, 3154 bp, Homo sapiens
  Payload ID: 5404
  Gene Symbol: ELMO1
  Gene Name: engulfment and cell motility 1
  Uniprot ID: Q92556
  ENST ID: ENST00000442504
  CDS Start-End: 711-2894
ataaacgcaggtcacctgagccagtagcagcaacctgggtccccttccacgctgtggaatctttgtttttttttcactgctcgcaataaatcttgctgctgcttattatttgggtccgtgttacctttatgagctgtagcactcaccgcgaaggtttgcagcttcgctattcactcttgaagccagcgagaccacgaacccaccgggaggaagaaacaactccggacgcgccacctttaagagctgtaacactaacggtgaaagtctgcggtatcactcctgaagtcagggagaccacgaaccccccagaagaaactccggacgcatctgaacatctgaaggaacaaactctggacacaccatctttaagaactgaaacaccgcgacagttcgctgcttcattcttaaaggcagtgagaccgagaacgcaccaattctggacacaaaaggaccttagcaggctcaggaaatggcaagccatttatgaagagggaagagatagcaaacgttggtctcaagttctctagttctttacccagaccatagctggctgggggatgatcctgatttagtctggggggttcctttacgcattgccaccagcaggtgccgcaaatggaccattggcagtcttaaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttgctttggagacatgctgtccttcaccctgacggccttcgttgagctgatggaccatggcatagtgtcctgggatacattttcggtggcgttcattaagaagatagcaagttttgtgaacaagtcagccatagacatctcgatcctgcagcggtccttggccattttggagtcgatggtgctcaatagccatgacctctaccagaaagtggcgcaggagatcaccatcggccagctcattccacacctgcaagggtcagatcaagaaatccaaacctatactattgcagtgattaatgcgcttttcctgaaggctcctgatgagaggaggcaggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaag

SEQ ID NO: 129853 - DNA, 580 bp, Homo sapiens
  Payload ID: 5404
  Gene Symbol: ELMO1
  Gene Name: engulfment and cell motility 1
  ENST ID: ENST00000433246
  CDS Start-End: 1-580
atcaagaaatccaaacctatactattgcagtgattaatgcgcttttcctgaaggctcctgatgagaggaggcaggttgatgtagagagcaatgttgacatccttgattgtcctctgactgagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttgg

SEQ ID NO: 129854 - DNA, 650 bp, Homo sapiens
  Payload ID: 5404
  Gene Symbol: ELMO1
  Gene Name: engulfment and cell motility 1
  ENST ID: ENST00000455879
  CDS Start-End: 202-650
gaccatgacttcctgggcaatctgtccttcctcagactgttgagtgccagacgtttatatgcatgtctggacagagagtgagcctggctcattcagaccctgggcaccattcagagcagaactcagtggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttg

SEQ ID NO: 129855 - DNA, 3669 bp, Homo sapiens
  Payload ID: 5405
  Gene Symbol: ELMO2
  Gene Name: engulfment and cell motility 2
  Uniprot ID: Q96JJ3
  ENST ID: ENST00000290246
  CDS Start-End: 196-2358
gcgggcggaggctggaggagccgccgagcggagacccgggagcaggagctgggcctaggtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgtacaaac

SEQ ID NO: 129856 - DNA, 2157 bp, Homo sapiens
  Payload ID: 5405
  Gene Symbol: ELMO2
  Gene Name: engulfment and cell motility 2
  ENST ID: ENST00000352077
  CDS Start-End: 1-2157
atgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccatgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctga

SEQ ID NO: 129857 - DNA, 3678 bp, Homo sapiens
  Payload ID: 5405
  Gene Symbol: ELMO2
  Gene Name: engulfment and cell motility 2
  Uniprot ID: Q96JJ3
  ENST ID: ENST00000372176
  CDS Start-End: 470-2368
gtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtaggttgaaatggacctcgttttcaacagtggcagctccgactgaaagagcactcctacaccttgaggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgtacaaa

SEQ ID NO: 129858 - DNA, 3574 bp, Homo sapiens
  Payload ID: 5405
  Gene Symbol: ELMO2
  Gene Name: engulfment and cell motility 2
  Uniprot ID: Q96JJ3
  ENST ID: ENST00000396391
  CDS Start-End: 107-2269
tcccaagaaggcggggcgggcggaggctggaggagccgccgagcggagacccgggagcaggagctgggcctaggtctgcgccctgaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgt

SEQ ID NO: 129859 - DNA, 1344 bp, Homo sapiens
  Payload ID: 5405
  Gene Symbol: ELMO2
  Gene Name: engulfment and cell motility 2
  ENST ID: ENST00000425546
  CDS Start-End: 1-804
gaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggtcagtgtctccgggctgctctgaggcccacgggaggagaccatcacacgacagcctttgacagctggctggcacctggagaatccctgagctggaaaagcagcttggtctgcagaactgagtcacaagactgaggcactggggagcctcagccccatctggttgttgctccctctgtgaccttgagcttgtcttccacttggtgccgtaggccctcatttgtccattgaagttagcacctgtccctcccgtcctccagagaggtcaggaggataagcattagaagactcactgtggtttattgagtgcttactgtgcaggtactgctgtagttttgtgaactgggaaggttaggagagaagagtggactggcatgatgtgcacaccctgggtacttaatcgatagttatccctcggtgctttcagtcctcactctatgcagagcactgttgtgccaggccctcaaaagctgatcatctaggggtcgagtgttttgaagttgatcatctcatcataaaaaatttggaaagtataaagaataaaaagttacctgtatttacacca

SEQ ID NO: 129860 - DNA, 2158 bp, Homo sapiens
  Payload ID: 5405
  Gene Symbol: ELMO2
  Gene Name: engulfment and cell motility 2
  ENST ID: ENST00000452857
  CDS Start-End: 1-852
taccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaaacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgta

SEQ ID NO: 129861 - DNA, 1168 bp, Homo sapiens
  Payload ID: 5405
  Gene Symbol: ELMO2
  Gene Name: engulfment and cell motility 2
  ENST ID: ENST00000450812
  CDS Start-End: 154-1168
ggaggagccgccgagcggagacccgggagcaggagctgggcctaggtctgcgccctggagggaggtgtagaaagaggtacatggagaacaagtttgtcaatccgtctgaacttcagttgccttacctgtaagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccg

SEQ ID NO: 129862 - DNA, 4121 bp, Homo sapiens
  Payload ID: 5405
  Gene Symbol: ELMO2
  Gene Name: engulfment and cell motility 2
  ENST ID: ENST00000467800
  CDS Start-End: 1-1325
gccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggtgagtagagaggccagtttgagtagctggcccagtgatacttggagagtgccattggtggtggttttttccaggtgcattcttggcatcttcccctctctattcctgaatgttttattaagaattttgaacatacacaaaaatagatggaacctctgtatacacatcacccagactcagcaaccatggccagttctgcccatccacttgtttctctcctttatcgctttgaagaaagtcccaagtatcacactgtttcatctgtaaatatttagtgtacatcgtatagtgtataacattgccaccagtccattagcacacataacaggaaatgaaagtagttatttcagatcaaatattccactgatggtgactttctaccaattgtcttataaatgtcataatttctctacagatatataaatgtttatatggatacacacacacacacacacacacacacacacacacacacacacacccccatacccatcttgtctaaaccagagtctaagactggtcttttaagtttcttaattcataagttcccccgcccccccatcccccaccatcttttcctttgcagtttattagctgaagaaccagattgcttgtttggtagtttcctagcatctgaattttgctgattgtttccccgtggtacagtttaacttgttcctctgtcccagatctgtacattggaagagggatctagaggtttgatccagttcaggtttaacttttttcctggccagtgtcatcagtggtattatgttctatcaagaggcacataacgtctggtggtctctccttttgtgataattagcagactgttgaagctcagtgcctcattccatcagtcaactaaggtttgcaaactcatgatattttgatgcagtcattgcttttcatttatgagctgaaccatgaaacttgcccttatctactattggtttcccagtggtacagtttatataggaaacgagaataaatgctgattcttcttttatgtacttactttcaaaataatgagttagttccttggtatcatgcaacagtgaccaattttgtgtgtgtgtgtgttttgttttgttttttaattgttaagacattcctatgccaaatacagcacgatagaagttgttagtcatcttggtaatataaaaacttttaggataacttacagtcatggatcgtgaccttccagggttctgagtgttgaaaatgacttttttccaatcttaaaaatatcacaacatctttgatgtgacttgggcagggagtgggtaagttaaggttgatttatgctgggcctcatctccagccacacttgtggccgcctaggagcattgatgacattcatctgaatcagcatgtttggtgatgatgccgagtcactaggactttggccaagatcttgatgtgcagaccccaggctgttccatcgctctaatttaaaccctttctccttcaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgtacaaa

SEQ ID NO: 129863 - DNA, 2480 bp, Homo sapiens
  Payload ID: 5406
  Gene Symbol: ELMO3
  Gene Name: engulfment and cell motility 3
  ENST ID: ENST00000360833
  CDS Start-End: 58-2328
ctacccccagactccaacccggaactaacctcggctcccttgggaaggccgcgttgcatggccaggagcagcagtctgggccgcgagtgcgggacaccgaggtcaggtctcggaaagggaggacctcctcgtccccaggggccccaggccaggtgcacccttggccgcaggtgcacggtctccggaaagtgcaggcgcccacgtcccagctggaccatggcgcctccgcggaacgtggtgaagattgccatcaagatgcgtgacgccatcccgcagctcatccagctggaccaggcgaagcccctggccgctgtgctgaaggaggtgtgcgacgcgtggagcctgacgcactctgagcgttacgccctgcagtttgcggatgggcaccggagatacatcaccgagaatgaccttgaggctgagcagctcttgggtgggctgcagagtaacagtcctgaagggcgccgggaagccctgaggcgccttgttccgctggcctcggacatgatctttgccagggaggtcatcagccgtaatgggctccagatactaggcaccatcattgaagatggggacgacctaggagaggtgctggccctcagcctgagggccttctcagagctcatggagcacggcgtggtgtcctgggagactctgagcatcccctttgtgaggaaggtggtgtgctacgtgaacatgaacctcatggatgcctccgtgcctcccctggcccttgggctgctggagagtgtgaccttgagcagcccagccctgggccagctggtcaagagcgaggtgcccctggataggctgctggtgcacctacaggtgatgaaccagcagctgcaaaccaaggccatggccctgctgacagccttgctgcagggggccagccctgtggaacgcaagcacatgcttgactatctttggcagaggaaccttcgccagttcatctataagaacatcatccacagtgcagcaccaatgggcgacgagatggctcatcacctgtacgtactgcaggctctcatgctggggctgctggagccgcgcatgcggacgcccctggacccctacagccaggagcagcgggagcagctgcaggtcctacgccaggctgccttcgaggtggagggggagtcctcgggtgccgggctaagtgctgaccgtcgccgttccctctgtgcccgagagttccgcaaactgggcttttctaacagcaacccagcacaggacctggagcgcgtgccccccggtctgctggccctggacaacatgttgtacttctccagaaacgcgcccagcgcgtacagccggtttgtgttggagaacagcagccgcgaggacaagcacgagtgcccctttgcccggggcagcatccagctgacggtgctgctgtgtgagctgctccgtgttggggagccctgctctgagacagcccaggacttctcacccatgttcttcggccaagaccagagcttccacgagctcttctgtgtgggcatccagctgttgaataagacctggaaggagatgcgggctacacaggaggacttcgacaaggtcatgcaggtggtgcgggagcagctggcccgcactctggccctgaagcccacttccctggagctcttccgaaccaaggtgaatgcgctcacttatggggaggtgctgcggctgcggcagactgaacggctgcaccaggagggcacactggctccccctatactggagctgcgggagaagctgaagccagagctcatgggcctgatccgccagcagcgcttgctccgcctctgtgaggggacgctcttccgcaagatcagcagccggcggcgccaggataagctgtggttctgctgcctgtcccccaaccacaagctgctgcagtacggagacatggaggagggcgccagcccgcctaccctggagagtctgcccgagcaactccctgtggccgacatgagggcactcctgacaggcaaggactgcccccatgtccgggagaagggctccgggaagcagaacaaggacctctatgagttggccttctcaatcagctatgaccgtggggaggaggaagcgtacctcaacttcattgccccctccaagcgggagttctacctgtggacagatgggctcagtgccttgctgggcagtcccatgggcagcgagcagacacggctggacctggagcagctgctgaccatggagaccaagctgcgtctgctggagctggagaacgtgcccatccccgagcggccaccccctgtgcccccaccccccaccaacttcaacttctgctatgactgcagcatcgctgaaccttgacagtgtggctggccatgggccacagctgcggccactgcagcagccatgaagggcagtgggtagaggagtgcaggcaccctgaccagcagagattgctgcagaaataaagtctgcttggctcttgggatatgttgagccagctctgtaccttg

SEQ ID NO: 129864 - DNA, 2531 bp, Homo sapiens
  Payload ID: 5406
  Gene Symbol: ELMO3
  Gene Name: engulfment and cell motility 3
  Uniprot ID: Q96BJ8
  ENST ID: ENST00000393997
  CDS Start-End: 58-2379
ctacccccagactccaacccggaactaacctcggctcccttgggaaggccgcgttgcatggccaggagcagcagtctgggccgcgagtgcgggacaccgaggtcaggtctcggaaagggaggacctcctcgtccccaggggccccaggccaggtgcacccttggccgcaggtgcacggtctccggaaagtgcaggcgcccacgtcccagctggaccatggcgcctccgcggaacgtggtgaagattgccatcaagatgcgtgacgccatcccgcagctcatccagctggaccaggcgaagcccctggccgctgtgctgaaggaggtgtgcgacgcgtggagcctgacgcactctgagcgttacgccctgcagtttgcggatgggcaccggagatacatcaccgagaataaccgcgcggagatcaagaatggcagcatcctgtgcctcagcacggccccagaccttgaggctgagcagctcttgggtgggctgcagagtaacagtcctgaagggcgccgggaagccctgaggcgccttgttccgctggcctcggacatgatctttgccagggaggtcatcagccgtaatgggctccagatactaggcaccatcattgaagatggggacgacctaggagaggtgctggccctcagcctgagggccttctcagagctcatggagcacggcgtggtgtcctgggagactctgagcatcccctttgtgaggaaggtggtgtgctacgtgaacatgaacctcatggatgcctccgtgcctcccctggcccttgggctgctggagagtgtgaccttgagcagcccagccctgggccagctggtcaagagcgaggtgcccctggataggctgctggtgcacctacaggtgatgaaccagcagctgcaaaccaaggccatggccctgctgacagccttgctgcagggggccagccctgtggaacgcaagcacatgcttgactatctttggcagaggaaccttcgccagttcatctataagaacatcatccacagtgcagcaccaatgggcgacgagatggctcatcacctgtacgtactgcaggctctcatgctggggctgctggagccgcgcatgcggacgcccctggacccctacagccaggagcagcgggagcagctgcaggtcctacgccaggctgccttcgaggtggagggggagtcctcgggtgccgggctaagtgctgaccgtcgccgttccctctgtgcccgagagttccgcaaactgggcttttctaacagcaacccagcacaggacctggagcgcgtgccccccggtctgctggccctggacaacatgttgtacttctccagaaacgcgcccagcgcgtacagccggtttgtgttggagaacagcagccgcgaggacaagcacgagtgcccctttgcccggggcagcatccagctgacggtgctgctgtgtgagctgctccgtgttggggagccctgctctgagacagcccaggacttctcacccatgttcttcggccaagaccagagcttccacgagctcttctgtgtgggcatccagctgttgaataagacctggaaggagatgcgggctacacaggaggacttcgacaaggtcatgcaggtggtgcgggagcagctggcccgcactctggccctgaagcccacttccctggagctcttccgaaccaaggtgaatgcgctcacttatggggaggtgctgcggctgcggcagactgaacggctgcaccaggagggcacactggctccccctatactggagctgcgggagaagctgaagccagagctcatgggcctgatccgccagcagcgcttgctccgcctctgtgaggggacgctcttccgcaagatcagcagccggcggcgccaggataagctgtggttctgctgcctgtcccccaaccacaagctgctgcagtacggagacatggaggagggcgccagcccgcctaccctggagagtctgcccgagcaactccctgtggccgacatgagggcactcctgacaggcaaggactgcccccatgtccgggagaagggctccgggaagcagaacaaggacctctatgagttggccttctcaatcagctatgaccgtggggaggaggaagcgtacctcaacttcattgccccctccaagcgggagttctacctgtggacagatgggctcagtgccttgctgggcagtcccatgggcagcgagcagacacggctggacctggagcagctgctgaccatggagaccaagctgcgtctgctggagctggagaacgtgcccatccccgagcggccaccccctgtgcccccaccccccaccaacttcaacttctgctatgactgcagcatcgctgaaccttgacagtgtggctggccatgggccacagctgcggccactgcagcagccatgaagggcagtgggtagaggagtgcaggcaccctgaccagcagagattgctgcagaaataaagtctgcttggctcttgggatatgttgagccagctctgtaccttg

SEQ ID NO: 129865 - DNA, 2281 bp, Homo sapiens
  Payload ID: 5406
  Gene Symbol: ELMO3
  Gene Name: engulfment and cell motility 3
  Uniprot ID: Q96BJ8
  ENST ID: ENST00000477898
  CDS Start-End: 306-2129
atccctccctgcccaggccgcgagaatgaccactccacttgcaggcgaagcccctggccgctgtgctgaaggaggtgtgcgacgcgtggagcctgacgcactctgagcgttacgccctgcagtttgcggatgggcaccggagatacatcaccgagaataaccgcgcggagatcaagaatggcagcatcctgtgcctcagcacggccccagaccttgaggctgagcagctcttgggtgggctgcagagtaacagtcctgaagggcgccgggaagccctgaggcgccttgttccgctggcctcggacatgatctttgccagggaggtcatcagccgtaatgggctccagatactaggcaccatcattgaagatggggacgacctaggagaggtgctggccctcagcctgagggccttctcagagctcatggagcacggcgtggtgtcctgggagactctgagcatcccctttgtgaggaaggtggtgtgctacgtgaacatgaacctcatggatgcctccgtgcctcccctggcccttgggctgctggagagtgtgaccttgagcagcccagccctgggccagctggtcaagagcgaggtgcccctggataggctgctggtgcacctacaggtgatgaaccagcagctgcaaaccaaggccatggccctgctgacagccttgctgcagggggccagccctgtggaacgcaagcacatgcttgactatctttggcagaggaaccttcgccagttcatctataagaacatcatccacagtgcagcaccaatgggcgacgagatggctcatcacctgtacgtactgcaggctctcatgctggggctgctggagccgcgcatgcggacgcccctggacccctacagccaggagcagcgggagcagctgcaggtcctacgccaggctgccttcgaggtggagggggagtcctcgggtgccgggctaagtgctgaccgtcgccgttccctctgtgcccgagagttccgcaaactgggcttttctaacagcaacccagcacaggacctggagcgcgtgccccccggtctgctggccctggacaacatgttgtacttctccagaaacgcgcccagcgcgtacagccggtttgtgttggagaacagcagccgcgaggacaagcacgagtgcccctttgcccggggcagcatccagctgacggtgctgctgtgtgagctgctccgtgttggggagccctgctctgagacagcccaggacttctcacccatgttcttcggccaagaccagagcttccacgagctcttctgtgtgggcatccagctgttgaataagacctggaaggagatgcgggctacacaggaggacttcgacaaggtcatgcaggtggtgcgggagcagctggcccgcactctggccctgaagcccacttccctggagctcttccgaaccaaggtgaatgcgctcacttatggggaggtgctgcggctgcggcagactgaacggctgcaccaggagggcacactggctccccctatactggagctgcgggagaagctgaagccagagctcatgggcctgatccgccagcagcgcttgctccgcctctgtgaggggacgctcttccgcaagatcagcagccggcggcgccaggataagctgtggttctgctgcctgtcccccaaccacaagctgctgcagtacggagacatggaggagggcgccagcccgcctaccctggagagtctgcccgagcaactccctgtggccgacatgagggcactcctgacaggcaaggactgcccccatgtccgggagaagggctccgggaagcagaacaaggacctctatgagttggccttctcaatcagctatgaccgtggggaggaggaagcgtacctcaacttcattgccccctccaagcgggagttctacctgtggacagatgggctcagtgccttgctgggcagtcccatgggcagcgagcagacacggctggacctggagcagctgctgaccatggagaccaagctgcgtctgctggagctggagaacgtgcccatccccgagcggccaccccctgtgcccccaccccccaccaacttcaacttctgctatgactgcagcatcgctgaaccttgacagtgtggctggccatgggccacagctgcggccactgcagcagccatgaagggcagtgggtagaggagtgcaggcaccctgaccagcagagattgctgcagaaataaagtctgcttggctcttgggatatgttgagccagctctgtaccttg

SEQ ID NO: 129866 - DNA, 780 bp, Homo sapiens
  Payload ID: 5406
  Gene Symbol: ELMO3
  Gene Name: engulfment and cell motility 3
  ENST ID: ENST00000571587
  CDS Start-End: 3-290
gcatggccaggagcagcagtctgggccgcgagtgcgggacaccgaggtcaggtctcggaaagggaggacctcctcgtccccaggggccccaggccaggtgcacccttggccgcaggtgcacggtctccggaaagtgcaggcgcccacgtcccagctggaccatggcgcctccgcggaacgtggtgaagattgccatcaagatgcgtgacgccatcccgcagctcatccagctggaccaggcgaagcccctggccgctgtgctgaaggaggtggagcctgacgcactctgagcgttacgccctgcagtttgcggatgggcaccggagatacatcaccgagaataaccgcgcggagatcaagaatggcagcatcctgtgcctcagcacggccccacctaggagaggtgctggccctcagcctgagggccttctcagagctcatggagcacggcgtggtgtcctgggagactctgagcatcccctttgtgaggaaggtggtgtgctacgtgaacatgaacctcatggatgcctccgtgcctcccctggcccttgggctgctggagagtgtgaccttgagcagcccagccctgggccagctggtcaagagcgaggtgcccctggataggctgctggtgcacctacaggtgatgaaccagcagctgcaaaccaaggccatggccctgctgacagccttgctgcagggggccagccctgtggaacgcaagaggaaccttcgccagttcatctataagaacatcatccacagtgcagcaccaatggg

SEQ ID NO: 129867 - DNA, 3763 bp, Homo sapiens
  Payload ID: 5407
  Gene Symbol: EDC3
  Gene Name: enhancer of mRNA decapping 3
  Uniprot ID: Q96F86
  ENST ID: ENST00000315127
  CDS Start-End: 183-1709
acggtggtggcgtggagacgtgggggcgcttccggcagcggcggcggtggtgaaggccgatgctgtgggggtgggcgtggagagaattcttctgtgggtcctctggtgttgagtggtcggcttggtgtggtgtgcggaggagctccaggcccgtcggcgcggagtggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaagtgggcatcaatcagaatggcacaggcaagtttgtcaagaagccagcctcttccagcagtgcccctcagaatatccctaagaggacagatgtgaagagccaggatgttgccgtttccccgcagcagcaacagtgctcaaagagctatgtcgacaggcacatggaatccttgagtcagtccaaaagtttccgtcgtcggcacaactcctggtcatctagtagcaggcacccaaatcaggcaactcccaagaaaagtggtttaaagaatggccagatgaagaataaagatgacgagtgcttcggggatgatattgaggagatcccagacacagattttgattttgaagggaacctggctctttttgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctcttttgggtttgtttcttctgtgagagaacagaacttacttaaaactgacctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctgcactctccattcatgtccagggctgtgacagaccaggccttcccctagccccacaagttgatttggggggttttgacccttactcctgagctgatccaagttttatgctgatttttccaaggatctctccctccttttccctccatcactcagaggtagggaagggggcggcattaggatggtgttactgtattgggattttatgttgttctgtcgtcttcagcacaggtagtataaggttatattactgtagaaccacagtgcccatcttgccagcagtgcccgcccccaccctcaaagctgagcaggttgagcctttgcctagtctggggccagacccctcagatggggatatccctgggggagcctggtgctgaaccagaagaggcttcctggtgcttctgtcctaggccaccactcctccagccctttgcccgcacatacatgccccacctactctttcatcccctctgcccttcccctgaaacggtcctttgcagctgtcatcccagagcaggcagatgggctcccgtgcttgagctccaccccagctcttacatcatctgggctttgaaccttttacatttgtccagtctagatgagtaggcttggggccagcaccctgtctcaaagatggcaaaatgaggctagttctggatgagctagctggtgtgggttccaaccataggaacacactgatgctcaaatcctaaggtgccaagctctaggccctggaggctggtagaacaggatctatgcctggaatcctggcagggattcctgtcaaggacttgtgtttaagcctgcttcagggcttcaggctgcttctgctctgtgtctgcccaggctggctgagcgggtggatgggtggacagaagggctcaccaaggattgtggacatagggtaggccctggtaccacgggtttcaggctgttatcacttcccttgtaggaacatagccagaagcagatgagccagggtagagggctggcccctcctctcatcttcccttcagtcttaaattgtctccagcgatgggaagaggccagggactgtaacccttgtgctgtgtattctctgagcctctgctcactctcagggccaagcagctcccaagccggggccctctcttggccaaaatctgaggagcagtctaggttacaggctttttggtaggtaggttctggctgcctgttaatgcagttaggccccctgattaggtacagtgagaaacaagctagaacaaccctggcccagaagactgtccactccagcaagatccagggatgatagccttgcagggccactgggagtttgtgcccaagcttctccctcttctctccccagggggcactgggactggtccctgccctcatccttagcctgggccttccccagaggtattaaagagaagtatgattcctctgtcttcagttcttttcaggggcatcctgcccatagtacccagttcccaaggggcccccagtcacgtggtgaagcctagcactcatgcagctcttagggaaccaaaaaccagcactgaaataaagctgaatgactgactga

SEQ ID NO: 129868 - DNA, 2093 bp, Homo sapiens
  Payload ID: 5407
  Gene Symbol: EDC3
  Gene Name: enhancer of mRNA decapping 3
  Uniprot ID: Q96F86
  ENST ID: ENST00000426797
  CDS Start-End: 464-1990
gggcgcttccggcagcggcggcggtggtgaaggccgatgctgtgggggtgggcgtggagagaattcttctgtgggtcctctggtgttgagtggtcggcttggtgtggtgtgcggaggagctccaggcccgtcggcgcggaggctttcaggtataggctgggtcactagtcttaaaacatttcttcttgagaatgtctaaaagactgtggaatctgttagatcttatatacttttaagttggcacctgaaacttttcatcctagatttacatagtggtcttgctgtgttgcccagcctggtcttgaattcctggactcaagtgatgctcctgccttggcttcccaaactcctggaattacaactcaatgaatgacggtttttgttgctccacatcctcgtcagcatttggtgttgtcagtgttttggatttcggccattctgacagtggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaagtgggcatcaatcagaatggcacaggcaagtttgtcaagaagccagcctcttccagcagtgcccctcagaatatccctaagaggacagatgtgaagagccaggatgttgccgtttccccgcagcagcaacagtgctcaaagagctatgtcgacaggcacatggaatccttgagtcagtccaaaagtttccgtcgtcggcacaactcctggtcatctagtagcaggcacccaaatcaggcaactcccaagaaaagtggtttaaagaatggccagatgaagaataaagatgacgagtgcttcggggatgatattgaggagatcccagacacagattttgattttgaagggaacctggctctttttgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctcttt

SEQ ID NO: 129869 - DNA, 588 bp, Homo sapiens
  Payload ID: 5407
  Gene Symbol: EDC3
  Gene Name: enhancer of mRNA decapping 3
  ENST ID: ENST00000563292
  CDS Start-End: 312-588
agtatggggattgtgtggggagtgaggcattagctgcttgggcccttagtccagccttgttggtggctgctgcagttctttggctcactcactctgttcttcgtgcctcagtttccctttgcataatgagatacggtggcagagaagaacgccagtgccacatccatgactgatagcttgaggacggagatgaactggagggtagaaaaagaggatgcctgagaaatttatacctaccaggtcacatcttcgaatcccaggaagttatccctggattcatttctgcctttgattggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaag

SEQ ID NO: 129870 - DNA, 1862 bp, Homo sapiens
  Payload ID: 5407
  Gene Symbol: EDC3
  Gene Name: enhancer of mRNA decapping 3
  ENST ID: ENST00000565602
  CDS Start-End: 169-342
gagacgtgggggcgcttccggcagcggcggcggtggtgaaggccgatgctgtgggggtgggcgtggagagaattcttctgtgggtcctctggtgttgagtggtcggcttggtgtggtgtgcggaggagctccaggcccgtcggcgcggagtggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggtcatctagtagcaggcacccaaatcaggcaactcccaagaaaagtggtttaaagaatggccagatgaagaataaagatgacgagtgcttcggggatgatattgaggagatcccagacacagattttgattttgaagggaacctggctctttttgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctcttttgggtttgtttcttctgtgagagaacagaacttacttaaaactgacctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctg

SEQ ID NO: 129871 - DNA, 761 bp, Homo sapiens
  Payload ID: 5407
  Gene Symbol: EDC3
  Gene Name: enhancer of mRNA decapping 3
  ENST ID: ENST00000562174
  CDS Start-End: 1-640
ggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaaggtgagcacttaggcagggctgggctgaaggcctcctccctccttagcagtttgatggtctcgtcatgccacccagtggcgacaggtggaaaggcactacgtgtgtaaggatggtgcttcgcctctaaggagtcttagaacagtaatatactacttcccatccccttatgcttctccctctccaactactcacatgaagagctggggacccattggtccattccacaaa

SEQ ID NO: 129872 - DNA, 967 bp, Homo sapiens
  Payload ID: 5407
  Gene Symbol: EDC3
  Gene Name: enhancer of mRNA decapping 3
  ENST ID: ENST00000563009
  CDS Start-End: 209-967
ccgatgctgtgggggtgggcgtggagagaattcttctgtgggtcctctggtgttgagtggtcggcttggtgtggtgtgcggaggagctccaggcccgtcggcgcggagcaatgaatgacggtttttgttgctccacatcctcgtcagcatttggtgttgtcagtgttttggatttcggccattctgacagtggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaagtgggcatcaatcagaatggcacaggcaagtttgtcaagaagccagcctcttccagcagtgcccctcagaatatccctaagaggacagatgtgaagagccaggatgttgccgtttccccgcagcagcaacagtgctcaaagagctatgtcgacaggcacatggaatccttgagtcagtccaaaagtttccgtcgtcggcacaactcctggtcatctagtagcaggcacccaaatcaggcaactcccaagaaaagtggtttaaagaatggccagatgaagaataaagatgacgagtgcttcggggatgatattgaggagatcccagacacagattttgattttgaagggaacctggctctttttgacaaggcagctgtgtttgaggagattgatacctatgaaaggagaagtggtacccgttcccggggcatcccaaatgaaaggcccactcggtaccgccatgatgagaacatcttggagtcc

SEQ ID NO: 129873 - DNA, 1825 bp, Homo sapiens
  Payload ID: 5407
  Gene Symbol: EDC3
  Gene Name: enhancer of mRNA decapping 3
  Uniprot ID: Q96F86
  ENST ID: ENST00000568176
  CDS Start-End: 229-1755
gcggtggtgaaggccgatgctgtgggggtgggcgtggagagaattcttctgtgggtcctctggtgttgagtggtcggcttggtgtggtgtgcggaggagctccaggcccgtcggcgcggagggtcttgctgtgttgcccagcctggtcttgaattcctggactcaagtgatgctcctgccttggcttcccaaactcctggaattacaacttggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaagtgggcatcaatcagaatggcacaggcaagtttgtcaagaagccagcctcttccagcagtgcccctcagaatatccctaagaggacagatgtgaagagccaggatgttgccgtttccccgcagcagcaacagtgctcaaagagctatgtcgacaggcacatggaatccttgagtcagtccaaaagtttccgtcgtcggcacaactcctggtcatctagtagcaggcacccaaatcaggcaactcccaagaaaagtggtttaaagaatggccagatgaagaataaagatgacgagtgcttcggggatgatattgaggagatcccagacacagattttgattttgaagggaacctggctctttttgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaa

SEQ ID NO: 129874 - DNA, 658 bp, Homo sapiens
  Payload ID: 5407
  Gene Symbol: EDC3
  Gene Name: enhancer of mRNA decapping 3
  ENST ID: ENST00000569561
  CDS Start-End: 126-658
ggggaagcgggtgcttttcatcgagcctgcaagaggggggcccaggcatcgaggctggggagtcgtgggtagagccccgattccagccaagacgccacaggacataatggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaagtgggcatcaatcagaatggcacaggcaagtttgtcaagaagccagcctcttccagcagtgcccctcagaatatccctaagaggacagatgtgaagagccaggatgttgccgtttccccgcagcagcaacagtgctcaaagagctatgtcgacaggcacatggaatccttgagtcagtccaaaagtttccgtcgtcggcacaactcctggtcatctagtagcaggcacccaaatcaggcaactcccaagaaaagtgg

SEQ ID NO: 129875 - DNA, 479 bp, Homo sapiens
  Payload ID: 5407
  Gene Symbol: EDC3
  Gene Name: enhancer of mRNA decapping 3
  ENST ID: ENST00000566119
  CDS Start-End: 386-479
gtgggggcgcttccggcagcggcggcggtggtgaaggccgatgctgtgggggtgggcgtggagagaattcttctgtgggtcctctggtgttgagtggtcggcttggtgtggtgtgcggaggagctccaggcccgtcggcgcggaggctttcaggtataggctgggtcactagtcttaaaacatttcttcttgagaatgtctaaaagactgtggaatctgttagatcttatatacttttaagttggcacctgaaacttttcatcctagatttacatagtggtcttgctgtgttgcccagcctggtcttgaattcctggactcaagtgatgctcctgccttggcttcccaaactcctggaattacaacttggtctcacgtgtgaaacatggctacagattggctgggaagtattgtgtccatcaattgtggagatagcttgggtgtctatcagggaagagtgtcagctgtggatcaggtca

SEQ ID NO: 129876 - DNA, 574 bp, Homo sapiens
  Payload ID: 5407
  Gene Symbol: EDC3
  Gene Name: enhancer of mRNA decapping 3
  ENST ID: ENST00000566828
  CDS Start-End: 204-574
tggtgttgagtggtcggcttggtgtggtgtgcggaggagctccaggcccgtcggcgcggagagatggtgtcttgctttgttgcccaggctggagtgcagtggtgtgatcatagctcactccatccactgactcatgggcccaagctcccttcctgcctcaggctcccaagtagctgagattactgtggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaagtgggcatcaatcagaatggcacaggcaagtttgtcaagaagccagcctcttccagcagtgcccctcagaatatccctaagaggacagatgtgaa

SEQ ID NO: 129877 - DNA, 688 bp, Homo sapiens
  Payload ID: 5407
  Gene Symbol: EDC3
  Gene Name: enhancer of mRNA decapping 3
  ENST ID: ENST00000566219
  CDS Start-End: 199-688
ccggcagcggcggcggtggtgaaggccgatgctgtgggggtgggcgtggagagaattcttctgtgggtcctctggtgttgagtggtcggcttggtgtggtgtgcggaggagctccaggcccgtcggcgcggagggtcatctagtagcaggcacccaaatcaggcaactcccaagaaaagtggtttaaagaatggccagatgaagaataaagatgacgagtgcttcggggatgatattgaggagatcccagacacagattttgattttgaagggaacctggctctttttgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagg

SEQ ID NO: 129878 - DNA, 204 bp, Homo sapiens
  Payload ID: 5407
  Gene Symbol: EDC3
  Gene Name: enhancer of mRNA decapping 3
  ENST ID: ENST00000562974
  CDS Start-End: 1-204
cctcagaatatccctaagaggacagatgtgaagagccaggatgttgccgtttccccgcagcagcaacagtgctcaaagagctatgtcgacaggcacatggaatccttgagtcagtccaaaagtttccgtcgtcggcacaactcctactctggcctggttgtcccaagtatttcctatgagctgcataaaaagctgttgtccgtg

SEQ ID NO: 129879 - DNA, 471 bp, Homo sapiens
  Payload ID: 5407
  Gene Symbol: EDC3
  Gene Name: enhancer of mRNA decapping 3
  ENST ID: ENST00000567813
  CDS Start-End: 308-471
gtccagccttgttggtggctgctgcagttctttggctcactcactctgttcttcgtgcctcagtttccctttgcataatgagatacggtggcagagaagaacgccagtgccacatccatgactgatagcttgaggacggagatgaactggagggtagaaaaagaggatgcctgagaaatttatacctaccaggtcacatcttcgaatcccaggaagttatccctggattcatttctgcctttgatgcaagtctgtggttcttttcagtacactttgtgtgatattgatttggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcag

SEQ ID NO: 129880 - DNA, 573 bp, Homo sapiens
  Payload ID: 5407
  Gene Symbol: EDC3
  Gene Name: enhancer of mRNA decapping 3
  ENST ID: ENST00000570138
  CDS Start-End: 270-573
ggattctaaatagtatggggattgtgtggggagtgaggcattagctgcttgggcccttagtccagccttgttggtggctgctgcagttctttggctcactcactctgttcttcgtgcctcagtttccctttgcataatgagatacggtggcagagaagaacgccagtgccacatccatgactgatagcttgaggacggagatgaactggagggtagaaaaagaggatgcctgagaaatttatacctaccagtggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaagtgggcatcaatcagaatggcacaggca

SEQ ID NO: 129881 - DNA, 711 bp, Homo sapiens
  Payload ID: 5407
  Gene Symbol: EDC3
  Gene Name: enhancer of mRNA decapping 3
  ENST ID: ENST00000566243
  CDS Start-End: 318-711
agcggcggcggtggtgaaggccgatgctgtgggggtgggcgtggagagaattcttctgtgggtcctctggtgttgagtggtcggcttggtgtggtgtgcggaggagctccaggcccgtcggcgcggagggtcttgctgtgttgcccagcctggtcttgaattcctggactcaagtgatgctcctgccttggcttcccaaactcctggaattacaactcaatgaatgacggtttttgttgctccacatcctcgtcagcatttggtgttgtcagtgttttggatttcggccattctgacagtggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaagtgggcatcaatcagaatggcacaggcaagtttgtcaagaagccagcctcttccagcagtgcccctcagaatatccctaagaggacagatgtgaagagccaggatgttgccgtttccc

SEQ ID NO: 129882 - DNA, 4800 bp, Homo sapiens
  Payload ID: 5408
  Gene Symbol: EDC4
  Gene Name: enhancer of mRNA decapping 4
  Uniprot ID: Q6P2E9
  ENST ID: ENST00000358933
  CDS Start-End: 240-4445
tttcttctccggccctggcaggttccgggagcctcggctcgtgggtgccggaagtggaggcggttggtggggttggcggggctcagcgacgctgcgcgggtggcggtttgcgaactgcgggtggactgtgtagtgaccggcgtcccgctgtctcgccccgtggcgggtgagcgagggtgcgtggtgcgcggcggcggcggaacgaacgcggtgcgggcggggcgcccgccgcagggcccatggcctcctgcgcgagcatcgacatcgaggacgccacgcagcacctgcgggacatcctcaagctggaccggcccgcgggcggccccagtgcagagagcccacggccatccagtgcctacaatggggacctcaatggacttctggtcccagacccgctctgctcaggtgatagtacctcagcaaacaagactggtcttcggaccatgccacccattaacctgcaagagaagcaggtcatctgtctctcaggagatgatagctccacctgcattgggattttggccaaggaggtggagattgtggctagcagtgactctagcatttcaagcaaggcccggggaagcaacaaggtgaaaattcagcctgtcgccaagtatgactgggaacagaagtactactatggcaacctgattgctgtgtctaactccttcttggcctatgccattcgggctgccaacaatggctctgccatggtgcgggtgatcagcgtcagcacttcggagcggaccttgctcaagggcttcacaggcagtgtggctgatctggctttcgcgcacctcaactctccacagctggcctgcctggatgaggcaggcaacctgttcgtgtggcgcttggctctggttaatggcaaaattcaagaagagatcttggtccatattcggcagccagagggcacgccactgaaccactttcgcaggatcatctggtgccccttcatccctgaggagagcgaagactgctgtgaggagagcagcccaacagtggccctgctgcatgaagaccgggctgaggtgtgggacctggacatgctccgctccagccacagtacctggcctgtggatgttagccagatcaagcagggcttcattgtggtaaaaggtcatagcacgtgcctcagtgaaggagccctctctcctgatgggactgtgctggctactgcgagccacgatggctatgtcaagttctggcagatctacattgaggggcaagatgagccaaggtgtctgcacgagtggaaacctcatgatgggcggcccctctcctgcctcctgttctgtgacaaccataagaaacaagaccctgatgtccctttctggaggttccttattactggtgctgaccagaaccgagagttaaagatgtggtgtacagtatcctggacctgcctgcagactattcgcttctccccagatatcttcagctcagtgagtgtgccccctagcctcaaggtttgcttggacctctcagcagaatacctgattctcagcgatgtgcaacggaaggtcctctatgtgatggagctgctgcaaaaccaggaggagggccacgcctgcttcagctccatctcggagttcctgctcacccaccctgtgctgagctttggtatccaggttgtgagtcgctgccggctacggcacactgaggtgctgcctgccgaagaggaaaatgacagcctgggtgctgatggtacccatggagccggtgccatggagtctgcggccggtgtgctcatcaagctcttttgtgtgcatactaaggcactgcaagatgtgcagatccgcttccagccacagctgaaccctgatgtggtggccccactgcccacccacactgcccacgaggacttcacatttggagagtctcggcccgaactgggctctgagggcctggggtcagccgctcacggctcccagcctgacctccgacgaatcgtggagctgcctgcacctgccgacttcctcagtctgagcagtgagaccaagcccaagttgatgacacctgacgccttcatgacacctagcgcctccttgcagcagatcactgcctctcccagcagcagcagcagcggtagcagcagcagcagcagcagtagcagcagctcccttacagctgtgtctgccatgagcagcacctcagctgtggacccctccttgaccaggccacctgaggagctgaccttgagccccaagctgcagctggatggcagcctgacaatgagcagcagtggcagccttcaggcaagcccgcgtggcctcctgcctggcctgctcccagccccagctgacaaactgactcccaaggggccgggccaggtgcctactgccacctctgcactgtccctggagctgcaggaagtggagcccctggggctaccccaagcctcccctagccgcactcgttcccctgatgtcatctcctcagcttccactgccctgtcccaggacatccctgagattgcatctgaggccctgtcccgtggttttggctcctctgcaccagagggccttgagccagacagtatggcttcagccgcctcggcactgcacctgctgtccccacggccccggccagggcccgagctcggcccccagctcgggcttgatggaggccctggggatggagatcggcataataccccctccctcctggaggcagccttgacccaggaggcctcgactcctgacagtcaggtttggcccacagcacctgacattactcgtgagacctgcagcaccctggcagaaagccccaggaatggccttcaggaaaagcacaagagcctggccttccaccgaccaccatatcacctgctgcagcaacgtgacagccaggatgccagtgctgagcaaagtgaccatgatgatgaggtggccagccttgcctctgcttcaggaggctttggcaccaaagttcctgctccacggctgcctgccaaggactggaagaccaagggatcccctcgaacctcacccaagctcaagaggaaaagcaagaaggatgatggggatgcagccatgggatcccggctcacagagcaccaggtggcagagccccctgaggactggccagcactaatttggcaacagcagagagagctggcagagctgcggcacagccaggaagagctgctgcagcgtctgtgtacccaactcgaaggcctgcagagcacagtcacaggccacgtagaacgtgcccttgagactcggcacgagcaggaacagcggcggctggagcgagcactggctgaggggcagcagcggggagggcagctgcaggagcagctgacacaacagttgtcccaagcactgtcgtcagctgtagctgggcggctagagcgcagcatacgggatgagatcaagaagacagtccctccatgtgtctcaaggagtctggagcctatggcaggccaactgagcaactcagtggctaccaagctcacagctgtggagggcagcatgaaagagaacatctccaagctgctcaagtccaagaacttgactgatgccatcgcccgagcagctgcagacacattacaagggccgatgcaggctgcctaccgggaagccttccagagtgtggtgctgccggcctttgagaagagctgccaggccatgttccagcaaatcaatgatagcttccggctggggacacaggaatacttgcagcagctagaaagccacatgaagagccggaaggcacgggaacaggaggccagggagcctgtgctagcccagctgcggggcctggtcagcacactgcagagtgccactgagcagatggcagccaccgtggccggcagtgttcgtgctgaggtgcagcaccagctgcatgtggctgtgggcagcctgcaggagtccattttagcacaggtacagcgcatcgttaagggtgaggtgagtgtggcgctcaaggagcagcaggccgccgtcacctccagcatcatgcaggccatgcgctcagctgctggcacacctgtcccctctgcccaccttgactgccaggcccagcaagcccatatcctgcagctgctgcagcagggccacctcaatcaggccttccagcaggcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatgga

SEQ ID NO: 129883 - DNA, 482 bp, Homo sapiens
  Payload ID: 5408
  Gene Symbol: EDC4
  Gene Name: enhancer of mRNA decapping 4
  ENST ID: ENST00000573985
  CDS Start-End: 1-465
ctgcctaccgggaagccttccagagtgtggtgctgccggcctttgagaagagctgccaggccatgttccagcaaatcaatgatagcttccggctggggacacaggaatgcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttg

SEQ ID NO: 129884 - DNA, 580 bp, Homo sapiens
  Payload ID: 5408
  Gene Symbol: EDC4
  Gene Name: enhancer of mRNA decapping 4
  ENST ID: ENST00000577105
  CDS Start-End: 1-406
ccgagcagctgcagacacattacaagggccgatgcaggctgcctaccgggaagccttccagagtgtggtgctgccggcctttgagaagagctgccaggccatgttccagcaaatcaatgatagcttccggctggggacacaggaatacttgcagcagctagaaagccacatgaagagccggaaggcacgggaacaggaggccagggagcctgtgctagcccagctgcggggcctggtcagcacactgcagagtgccactgagcagatggcagccaccgtggccggcagtgttcgtgctgaggtgcagcaccagctgcatgtggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaagg

SEQ ID NO: 129885 - DNA, 530 bp, Homo sapiens
  Payload ID: 5408
  Gene Symbol: EDC4
  Gene Name: enhancer of mRNA decapping 4
  ENST ID: ENST00000575033
  CDS Start-End: 1-530
cagagtgccactgagcagatggcagccaccgtggccggcagtgttcgtgctgaggtgcagcaccagctgcatgtggctgtgggcagcctgcaggagtccattttagcacaggtacagcgcatcgttaagggtgaggcccagcaagcccatatcctgcagctgctgcagcagggccacctcaatcaggccttccagcaggcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatgg

SEQ ID NO: 129886 - DNA, 2913 bp, Homo sapiens
  Payload ID: 5409
  Gene Symbol: EPC1
  Gene Name: enhancer of polycomb homolog 1 (Drosophila)
  Uniprot ID: Q9H2F5
  ENST ID: ENST00000263062
  CDS Start-End: 271-2781
gaatggctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccggaatggagaaggaagaggagtcggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagaaccttgcatctaaccagcagaaaagtggctttcgcctgaatatacagggtttagaaagaacactacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctc

SEQ ID NO: 129887 - DNA, 4057 bp, Homo sapiens
  Payload ID: 5409
  Gene Symbol: EPC1
  Gene Name: enhancer of polycomb homolog 1 (Drosophila)
  Uniprot ID: Q9H2F5
  ENST ID: ENST00000319778
  CDS Start-End: 304-2745
gcgtgcccgcgccgctgcgcgatgcagtgtggggaatggctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccggaatggagaaggaagaggagtcggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctcatctctcatgcttcaatttttcttttcttactgttaataggaaaaaaatcaacatctgtaaattaagaatacagcaattatctgtacagtactgcatatttgtaatacccttgtatatatgttacttgaatacagaaatgttcatttgtgatgctttgcacttgggggtggggggtgggagggaaatcaattgcaacaaagagtgtgagatgtgagattgtatagagatgaagtgtcatcacatcatgtgcatggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaaaaaaaaaaaggcatcagtttttttaaaaatggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccatttccttccacaccaaaaagtgttaaatcaagtatgcaaatggagtccttacaactggagtttatgttgtcttgccctttttttagcacaaaaaaaattgtacttttttattgtcgaattgtttaaaagacttcattctttacttgttcttacgaaaaggatataagggagaagaatgcagtaattgctgtacgtgtatcatcattccagtttctaaaaacagccagccagcttttttccttttaagattctccagaaggctgcaaggccagaaccacaaatatcgggtgccttcctttggaaatatttgacctctcttctgtgaagagaatggtacttaacagactactactagtgctttgtcagtaccgaagtctgaatgcccagtccaatggcatacattatccttaaggtttttaatcccacctggaaaaattgtgatagaattctcacaaaataaacccagggcattacatgttgacaaactaa

SEQ ID NO: 129888 - DNA, 3909 bp, Homo sapiens
  Payload ID: 5409
  Gene Symbol: EPC1
  Gene Name: enhancer of polycomb homolog 1 (Drosophila)
  Uniprot ID: Q9H2F5
  ENST ID: ENST00000375110
  CDS Start-End: 306-2597
agcgctcgcctgcttgccatcgcaaagttgttaaccccagagtcttctggctgtgctgcctcctctgcttttaatcttctgtggatatttctccgatttcccccaaaagcccacagatcctgggggaagccaccccattcggccaccgatcatggaagaaagtattactttttatttaccaaacattttaaagatgttggaagatccatatgctgcctggaggctgttgtttctagggacacaagtatccagcctatattgttacaattttttttcaagaactgccgtcttctttgcctgcactaatggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctcatctctcatgcttcaatttttcttttcttactgttaataggaaaaaaatcaacatctgtaaattaagaatacagcaattatctgtacagtactgcatatttgtaatacccttgtatatatgttacttgaatacagaaatgttcatttgtgatgctttgcacttgggggtggggggtgggagggaaatcaattgcaacaaagagtgtgagatgtgagattgtatagagatgaagtgtcatcacatcatgtgcatggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaaaaaaaaaaaggcatcagtttttttaaaaatggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccatttccttccacaccaaaaagtgttaaatcaagtatgcaaatggagtccttacaactggagtttatgttgtcttgccctttttttagcacaaaaaaaattgtacttttttattgtcgaattgtttaaaagacttcattctttacttgttcttacgaaaaggatataagggagaagaatgcagtaattgctgtacgtgtatcatcattccagtttctaaaaacagccagccagcttttttccttttaagattctccagaaggctgcaaggccagaaccacaaatatcgggtgccttcctttggaaatatttgacctctcttctgtgaagagaatggtacttaacagactactactagtgctttgtcagtaccgaagtctgaatgcccagtccaatggcatacattatccttaaggtttttaatcccacctggaaaaattgtgatagaattctcacaaaataaacccagggcattacatgttgacaaactaa

SEQ ID NO: 129889 - DNA, 3649 bp, Homo sapiens
  Payload ID: 5410
  Gene Symbol: EPC2
  Gene Name: enhancer of polycomb homolog 2 (Drosophila)
  Uniprot ID: Q52LR7
  ENST ID: ENST00000258484
  CDS Start-End: 35-2458
gccgcccgggctgttcctgtaaggcggggagacaatgagtaaactctccttccgagcgcgggcgctggacgccgccaagccgctgcctatctaccgcggcaaggacatgcctgatctcaacgactgcgtctccatcaaccgggccgtgccccagatgcccaccgggatggagaaggaggaggaatcggaacatcatttacagcgagcaatttcagcacagcaagtgtttagagaaaaaaaagagagtatggtcattcctgttcctgaggcagagagcaacgtcaactattacaatcgcttgtacaaaggagagtttaaacagccaaaacagttcattcatattcagccttttaatctagacaacgagcaaccagattatgatatggattcagaagatgagactttattaaatagacttaacagaaagatggaaattaagcctttgcaatttgaaattatgattgacagacttgaaaaagccagttctaatcagcttgtaacacttcaagaagcaaaactgctgctaaacgaagatgattaccttattaaagctgtatatgactactgggtgagaaaacgtaaaaactgcagggggccatccctcattcctcagataaaacaagagaaaagagatggctctaccaacaatgacccttatgttgcctttcggagaagaacagagaaaatgcaaactcgaaagaatcgtaagaatgatgaagcctcttatgaaaagatgttgaaactgagacgagaatttagtagagccataacaattttggaaatgattaagagaagagagaaaacaaaacgagaattattgcacttaaccttagaagttgtggagaaaagataccatttgggagactatggtggtgaaatccttaatgaagtaaaaatcagtagatcagaaaaagagttatatgccactccagcaactcttcataatggaaatcatcacaaagttcaagaatgtaaaactaagcaccctcatcatttgtctttgaaagaagaggcttctgatgtggttcgtcaaaagaagaagtacccaaagaagcctaaagcagaggctttgataacatctcagcaacccactcctgagacattgcctgtgatcaataagagtgacattaagcaatatgattttcacagctcagatgaagatgaatttccacaggtattgtccccagtatcagaaccggaagaagaaaatgatcctgatggtccctgtgctttcagaaggcgggcaggatgccagtattatgctcctcgtttggaccaagctaaccattcatgtgaaaattcagaattggcagatttggataagttgaggtataggcattgccttacaacacttacagtcccaagaagatgtataggatttgcaaggaggcgaattggcagaggtggaagggtcataatggaccgaatatccacagaacatgacccagtcctgaaacagatagaccctgaaatgctgaatagtttttcaagctcttcccaaactatagacttttcttctaatttctctcggaccaatgcttccagtaaacattgtgaaaatagactgtctctttctgaaatattaagcaatatcagatcatgtcgactacagtgtttccagccaaggctactaaatttacaggacagtgatagtgaagaatgtacctcaagaaaaccagggcagactgtgaacaataaaagagtttctgcagcatctgtagctttattgaacaccagcaagaatggcatatcagtaacagggggtatcacagaagagcagtttcagacacatcagcagcagttagttcagatgcaaaggcagcaacttgcccagcttcagcagaaacagcaatctcagcattcctcgcaacagacacatccaaaagcacagggctcaagcacctctgactgtatgtctaaaacacttgactcagccagcgcccactttgctgcatctgcagtggtcagtgcacctgttccaagtcgcagtgaggtagccaaggaacagaacactggccacaacaacataaacggtgttgtccagccttcaggaacctctaaaacattatactccaccaatatggctttatcatccagcccagggatttcagctgtacagcttgtaaggacagttggccacaccactacaaaccacttaatcccagcattgtgcacaagcagtcctcagacacttcccatgaacaattcctgcctgacaaatgcagtgcacctcaataatgtcagtgttgtttctccagtcaatgtgcatatcaatacacggacttcagcaccatcgccaacagccttaaaacttgccacagttgctgccagtatggacagagtgccaaaggttactcccagcagtgccatcagcagcatagcaagagagaaccacgaaccagaaagattgggcttaaatggaatagcagagacaacagtagctatggaagtgacataacctaaaacacgtggctctgacctgtgctgatggtgtgcagtcattcatattccagctgaatgcaaaaggcaacactctgtggatcacagagtgtaacaatggacctaaatggactatagtatattggatgttaaatccatatatgatgtatattttgtaaaattgggaaaatcactaccttgtaaaatagtttatttgtatcatcaatattatttctgttacttgaatagtagatattcatcatcatgcttttgcacttgaatttgcaactgaatggattttaaaaaataattctttaatgggatcatgagcatgaaatgggatcctgcatcacttgttttaactatttattttgccatgtttacattttgtatcttgtaaaaataaatccaactttgtgtctaaaaagttaaagattcatagctaggaaatgaaattcttgtaatttttttctaaaggaactgtaaagttttcacttggttcattttgtttcacaatttgactagatggactttttggtaaatactttagtggcatttcactgtcaaatatgaagttcaaggcaaaatagtattttctattactgtgcaggggaaagggatggatcgatacatgcaaatttaatgtagtaactcacttttccatatattttgaatgtatatttctatttatgataccaatttataaaaaataattacacagaaaaaatggaataggaaaaattatgcatctagcacatttaaactgtgcaaatatgaaaatttttcgaggattacattttatctgaaggctgcatattttaactggctttaaaactgtaacacatcacataaaagatactttaccaggtatgtattgcattatatcattgcaataattattggaagtctagatatcgagccatcccaggtgttgggcggggggagggttgtggcaagattgtcttttcaattttggagagttttcctgtggctacaaggcaagtaacgggttggaaaaagtctgactgtaagcgttggacaccttcatagtgtagtgttttagtgactttttttatacggttcttgtaaattagatacgtgtagtggtgtttcagaatgtttgtttatgcactagttcagacaactttccctgttacttgttcttgataagtgaaaactgcagggaaataaaaaatacatatcaaaacat

SEQ ID NO: 129890 - DNA, 672 bp, Homo sapiens
  Payload ID: 5410
  Gene Symbol: EPC2
  Gene Name: enhancer of polycomb homolog 2 (Drosophila)
  ENST ID: ENST00000397424
  CDS Start-End: 192-672
cttgccgtaagcggcggccgggaatggcgcaggggatgcgctggccgctcttggcgtacggtctctgtttacctttccacctccctctctcaggcgcggggctaattaatggcgtggtattatttggctaggaacatcatttacagcgagcaatttcagcacagcaagtgtttagagaaaaaaaagagagtatggtcattcctgttcctgaggcagagagcaacgtcaactattacaatcgcttgtacaaaggagagtttaaacagccaaaacagttcattcatattcagccttttaatctagacaacgagcaaccagattatgatatggattcagaagatgagactttattaaatagacttaacagaaagatggaaattaagcctttgcaatttgaaattatgattgacagacttgaaaaagccagttctaatcagcttgtaacacttcaagaagcaaaactgctgctaaacgaagatgattaccttattaaagctgtatatgactactgggtgagaaaacgtaaaaactgcagggggccatccctcattcctcagataaaacaagagaaaagagatggctctaccaacaatgacccttatgttgcctttcggagaagaacagagaaaatgcaaactcgaaagaatcgtaagaatgatgaagcctcttatg

SEQ ID NO: 129891 - DNA, 1624 bp, Homo sapiens
  Payload ID: 5410
  Gene Symbol: EPC2
  Gene Name: enhancer of polycomb homolog 2 (Drosophila)
  ENST ID: ENST00000409654
  CDS Start-End: 20-385
cctgtaaggcggggagacaatgagtaaactctccttccgagcgcgggcgctggacgccgccaagccgctgcctatctaccgcggcaaggacatgcctgatctcaacgactgcgtctccatcaaccgggccgtgccccagatgcccaccgggatggagaaggaggaggaatcggaacatcatttacagcgagcaatttcagcacagcaagtgtttagagaaaaaaaagagagtatggtcattcctgttcctgaggcagagagcaacgtcaactattacaatcgcttgtacaaaggagagtttaaacagccaaaacagttcattcatattcagctgaaattgcatcttaaattgctgttgttcaggattgaagtcttgttcttctaaagagaattttcatttgtttctgccaggcatttggggacactaccaaccggagaccacgttaaagtttttgcttgtttgttttgttcatttgtttttggaccacagtattagctttaatttaggctgcagatctgctcaaggttcagttctcaggaagattttttgcttctcctttctacctaagggcaagttgagaaatacaaaattctttgctttccctttctgcatggctaatttatttctttaatcttacactgagggcatagccctttggtaatgtatctttattcagtagcattctatactaatattaacacacaagcataaagcttttttctttcttatggtatatatagtaatgttgtgtcttttaattgatggcagtttagatttgatagaattcaataatagtcatattctctagtatgaatattaggttctttgtaatttgttcccgctttctcctttaacgtcatttatttttgctcttcccttcactctgtgtaccatagggactacgaaaattaccctcattcaccttctttcatatttaacatttccttggatgtgctattgaagtcttctttcccttcctatagctcattaaagacttaactcccttatgaaagccaccttgacttttctcactctacctgtcttctttgcttatcgtagtatcttttacatacttctgttagaggactcaccatactttattgcaattatttgtaaccattctttctctccttttagactgtgagctccttgagggcaggaactatatattttattttcttttgtgttttcagagtaaagtgcttggtttatagatgctcaataaatgatgtgtttgtcgactgaattgttttaaaatggctttaaaaagtcttttggtggtacagccattttccacagatttcttttctctgaaatagtctagagaaacacacatgcgaaaattatttatgtatatttttttctcctgtgttctttgactttgagtcctattagctttttgaatttgcctttaccttctatcagtcaggaaggagataactattcataatagaaattttaaggatctctcttaagccaaagtatcaattattttgtattttgataatattgcagttaggcaggaagaccatttgtaaaaaccattctaggaaaccaagaactaaaaatcgggtgtaactcatgtgggtcaggcccatcgaatacaataaacattattcttgt

SEQ ID NO: 129892 - DNA, 788 bp, Homo sapiens
  Payload ID: 5410
  Gene Symbol: EPC2
  Gene Name: enhancer of polycomb homolog 2 (Drosophila)
  ENST ID: ENST00000449013
  CDS Start-End: 1-381
gaacatcatttacagcgagcaatttcagcacagcaagtgtttagagaaaaaaaagagagtatggtcattcctgttcctgaggcagagagcaacgtcaactattacaatcgcttgtacaaaggagagtttaaacagccaaaacagttcattcatattcagcgcatttggggacactaccaaccggagaccacgttaaagtttttgcttgtttgttttgttcatttgtttttggaccacagtattagctttaatttaggctgcagatctgctcaaggttcagttctcaggaagattttttgcttctcctttctacctaagggcaagttgagaaatacaaaattctttgctttccctttctgcatggctaatttatttctttaatcttacactgagggcatagccctttggtaatgtatctttattcagtagcattctatactaatattaacacacaagcataaagcttttttctttcttatggtatatatagtaatgttgtgtcttttaattgatggcagtttagatttgatagaattcaataatagtcatattctctagtatgaatattaggttctttgtaatttgttcccgctttctcctttaacgtcatttatttttgctcttcccttcactctgtgtaccatagggactacgaaaattaccctcattcaccttctttcatatttaacatttccttggatgtgctattgaagtcttctttcccttcctatagctcattaaagacttaactcccttatgaaagccaccttgacttttctcactctacc

SEQ ID NO: 129893 - DNA, 724 bp, Homo sapiens
  Payload ID: 5410
  Gene Symbol: EPC2
  Gene Name: enhancer of polycomb homolog 2 (Drosophila)
  ENST ID: ENST00000457184
  CDS Start-End: 244-724
agcgagaggggtgaccgggcggcggcgggagaggcgcacgctcccgggcgcgggcgaacttgcgcacctggcacctgccacacagcgaaagcaccggccagcgagcggaggggcgccgcccccgccccctctccccggagcggaccgagaccgagcacgctcccgcgggccggcagcgccgcggagagagtggcgcgggcgctggacgccgccaagccgctgcctatctaccgcggcaaggacatgcctgatctcaacgactgcgtctccatcaaccgggccgtgccccagatgcccaccgggatggagaaggaggaggaatcggaacatcatttacagcgagcaatttcagcacagcaagtgtttagagaaaaaaaagagagtatggtcattcctgttcctgaggcagagagcaacgtcaactattacaatcgcttgtacaaaggagagtttaaacagccaaaacagttcattcatattcagccttttaatctagacaacgagcaaccagattatgatatggattcagaagatgagactttattaaatagacttaacagaaagatggaaattaagcctttgcaatttgaaattatgattgacagacttgaaaaagccagttctaatcagcttgtaacacttcaagaagcaaaactgctgctaaacgaagatgattaccttattaaagctgtatatgactactgggtgagaaaacgtaaaaact

SEQ ID NO: 129894 - DNA, 586 bp, Homo sapiens
  Payload ID: 5411
  Gene Symbol: ERH
  Gene Name: enhancer of rudimentary homolog (Drosophila)
  ENST ID: ENST00000555373
  CDS Start-End: 67-282
gttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtgtaagtattagccaacatgtcttttatcttgtattttctattgcttttctgtctgtttgaggtgatttatggtattgggagctaattatgtgcctgatactgatctttgcatttgcatagtgtatagtaattaatatttctcttacagaaataagagattggcaacataaagccaaaggcacagaaaaaaataactttgctaattgatatagttagtatccagaaaggatcctaattcagaagttccatgtgcctcttctttgttccttatacctaattttttttttcctttacagtctttgtcttaa

SEQ ID NO: 129895 - DNA, 1124 bp, Homo sapiens
  Payload ID: 5411
  Gene Symbol: ERH
  Gene Name: enhancer of rudimentary homolog (Drosophila)
  Uniprot ID: P84090
  ENST ID: ENST00000557016
  CDS Start-End: 395-709
cgacctccggcccaggatacttacgttgccgccatttttgagtagggctaatgaaagatgtctgatgtcactgtctataccggtgatcacttgagccgtatgtttaataacgaaagtacggaagacagcgtcttgaaaaaaaataattcttcctaaagcttggaaactttcccttacctttttgcctttatcgaagatggctgaaacagagtcagtagctgctctagctgccggaagtgactgtgcctctatgatccaaaaggctcttttgcgttgcactttcgacgacttccggcggctcctctcgcgaggattggctgttagcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttctttttttttttttacttaaacatttttatgatgatttagatggaagttgttcttcgtcacttaatgttggttccagtccttcaactgttcatatctactttataacattcacatactaacccttcttcaagatggggtggggggtggaaatgcagtttagccatgtcctcaagataaagtcttggtaaaaataaataaatgtcctttagttatattttc

SEQ ID NO: 129896 - DNA, 546 bp, Homo sapiens
  Payload ID: 5412
  Gene Symbol: ENY2
  Gene Name: enhancer of yellow 2 homolog (Drosophila)
  ENST ID: ENST00000339942
  CDS Start-End: 69-215
agctttctgtgtgcttaggtgcccgagctactgagggtctaagtccgggcagccgaagagtgtgcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttga

SEQ ID NO: 129897 - DNA, 567 bp, Homo sapiens
  Payload ID: 5412
  Gene Symbol: ENY2
  Gene Name: enhancer of yellow 2 homolog (Drosophila)
  ENST ID: ENST00000522766
  CDS Start-End: 89-244
ggaaatgcgtgttctagctttctgtgtgcttaggtgcccgagctactgagggtctaagtccgggcagccgaagagtgtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagataatgattttaaatgatatgatttgttttttgcttttgcataagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgattttt

SEQ ID NO: 129898 - DNA, 2966 bp, Homo sapiens
  Payload ID: 5412
  Gene Symbol: ENY2
  Gene Name: enhancer of yellow 2 homolog (Drosophila)
  ENST ID: ENST00000517311
  CDS Start-End: 144-314
aaatgcgtgttctagctttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagataatgattttaaatgatatgatttgttttttgcttttgcataagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtttgcttggattttgaaatgaatgggactttgtctttattactaattcaccaaatttgttgagcgcaaaagcaattaatgtagtttaagtatttagtatgtacagttctctgtgttaacagctgagaagtaagcaaccttttctgactgcatatggtgtattcctcttttgagtccccataatattttataaattgtaatgccccatcttgtactacagttgtcttattcgtattgtttataaactttgagggttaggactgggtcttactcatctttatgtgccttccttatgcttcaaagaatttaccatctaatggaagagaacatttgcaagttggctccataccaagctccttccacatactctactcatctgaactttgaatgcagaatctttaaattgcaaccccacatactaaggtcaagaaagaacttaatgggaattaatctccacccattagctttaccctgacatcaggattgccaaatccaatggactcttgtctattcttacgtgacttctgctggaaaatgcgaatgttgaccatcctgccacttggaactctcttcccactcctcacattgcttttgctaccactggaagttccttctgtttcttgtggagtaccttttgctgtctgggacttgtagataatggtgtttcctagggctccctccagggccctctgcctcactaactggatatacttttcctgagcaaatcccaggaaacttgcgtcagaccgtgacttcaaatacaggttgataaatgctaaactgtctccaaaccagacttcatcctagcctccacacccagacacccaactgctatggatcaactttttagaatatcctcacttcaaactgaccttacctaaaataatgactttttcccccaataattgcccctgctatattccttatttctgaatggtacctcctagctatatagattatctgaggagcttactgaaatgctgattctgaagataaggggcatggctttaagattctgtatttctggcgagtacccaactggtgctcatgctgctgattgagaaccacttctgaatatagcaaggctgtaaattatccactacgtgccctcgtaattgtcttagttcaagcccagattattgtagtagacttagtatttctttgccttagttgatctgtgacccctccaatatctattccacactgttgcctaagtggccttagtaaaattcaagtctggttattttattcccctgcttggaatttctcaatgtagaatgaaactcattcagcattaacacataggcccttcttgatctgacatcgtgtttctctagttagactaaagaatccccactatgaagttgtttcatccgtaagtacctttgaacccagaagccccctttctcatatgtttctcattcctgtttgcccttcagagttcagctttagttgctaaaacattcagacatccctctgacttagatcccccactactgtttttctgtgagaagcagctatgcataattcctcttcaacacagtagttcttgaaattttgcaggcctctcctggaaaggaggaaatgacttctctgactttgtatgatgcttatttgtggatgaatgggcaagggaaaaaatgaaggaacaagtgaatgaacagtatgggagtatgagaaaaggtataaattgggtatagttgagaaaaggattcaaattgatctttggttcgagagacaatttcatctttctgatgaatttaaagtgtagtctttgaaccagctgggcttaattatgtaaagttttgagcctgagataagcacacaatcacaaaacctacccaaacaagttttttgtttcacttcatctcttataaaacaatgttctaaagtaagtgatagggatgctcatcattctgctacctattatcacaatgaaaacaatcataaatagtacacaggaaaggtgagaaatagcggatagttcttatttcatagtactgtatatggaaataaaccaaatttgctcatagagatactattttattacctcaaaaatatataaaaatgaaaacgttatgaaaatattttaaaatgggatttaaaaataattgagaacatcacagcaatttagaatactaaagagcatagctttaaaatgatagtgctgagaactccccacctctaccccaccacctgtaggcttctttgacaacttacaaatgttctctagtttgtatctagaatcacttatatctttcaaataaaccaactttgtgaac

SEQ ID NO: 129899 - DNA, 857 bp, Homo sapiens
  Payload ID: 5412
  Gene Symbol: ENY2
  Gene Name: enhancer of yellow 2 homolog (Drosophila)
  ENST ID: ENST00000520147
  CDS Start-End: 73-375
tctgtgtgcttaggtgcccgagctactgagggtctaagtccgggcagccgaagagtgtggtaggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagagacaggtttcgccatgttgcccaggctggtcttgagctcccggactcaggcaatcctcctgcctcaaccttccagactgctgggatgacaggcgtgagccatcgtacccagccaacacaccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtttgcttggattttgaaatgaatgggactttgtctttattactaattcaccaaatttgttgagcgcaaaagcaattaatgtagtttaagtatttagtatgtacagttctctgtgttaacagctgagaagtaagcaaccttttctgactgcatatggtgtattcctcttttgagtccccataat

SEQ ID NO: 129900 - DNA, 1540 bp, Homo sapiens
  Payload ID: 5412
  Gene Symbol: ENY2
  Gene Name: enhancer of yellow 2 homolog (Drosophila)
  ENST ID: ENST00000523335
  CDS Start-End: 119-280
gcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtttgcttggattttgaaatgaatgggactttgtctttattactaattcaccaaatttgttgagcgcaaaagcaattaatgtagtttaagtatttagtatgtacagttctctgtgttaacagctgagaagtaagcaaccttttctgactgcatatggtgtattcctcttttgagtccccataatattttataaattgtaatgccccatcttgtactacagttgtcttattcgtattgtttataaactttgagggttaggactgggtcttactcatctttatgtgccttccttatgcttcaaagaatttaccatctaatggaagagaacatttgcaagttggctccataccaagctccttccacatactctactcatctgaactttgaatgcagaatctttaaattgcaaccccacatactaaggtcaagaaagaacttaatgggaattaatctccacccattagctttaccctgacatcaggattgccaaatccaatggactcttgtctattcttacgtgacttctgctggaaaatgcgaatgttgaccatcctgccacttggaactctcttcccactcctcacattgcttttgctaccactggaagttccttctgtttcttgtggagtaccttttgctgtctgggacttgtagataatggtgtttcctagggctccctccagggccctctgcctcactaactggatatacttttcctgagcaaatcccaggaaacttgcgtcagaccgtgacttcaaatacaggttgataaatgctaaactgtctccaaaccagacttcatcctagcctccacacccagacacccaactgctatggatcaactttttagaatatcctcacttcaaactgaccttacctaaaataatgactttttcccccaataattgcccctgctatattccttatt

SEQ ID NO: 129901 - DNA, 562 bp, Homo sapiens
  Payload ID: 5412
  Gene Symbol: ENY2
  Gene Name: enhancer of yellow 2 homolog (Drosophila)
  Uniprot ID: Q9NPA8
  ENST ID: ENST00000521662
  CDS Start-End: 89-379
ggaaatgcgtgttctagctttctgtgtgcttaggtgcccgagctactgagggtctaagtccgggcagccgaagagtgtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatga

SEQ ID NO: 129902 - DNA, 2922 bp, Homo sapiens
  Payload ID: 5412
  Gene Symbol: ENY2
  Gene Name: enhancer of yellow 2 homolog (Drosophila)
  Uniprot ID: Q9NPA8
  ENST ID: ENST00000521688
  CDS Start-End: 146-451
ggaaatgcgtgttctagctttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtttgcttggattttgaaatgaatgggactttgtctttattactaattcaccaaatttgttgagcgcaaaagcaattaatgtagtttaagtatttagtatgtacagttctctgtgttaacagctgagaagtaagcaaccttttctgactgcatatggtgtattcctcttttgagtccccataatattttataaattgtaatgccccatcttgtactacagttgtcttattcgtattgtttataaactttgagggttaggactgggtcttactcatctttatgtgccttccttatgcttcaaagaatttaccatctaatggaagagaacatttgcaagttggctccataccaagctccttccacatactctactcatctgaactttgaatgcagaatctttaaattgcaaccccacatactaaggtcaagaaagaacttaatgggaattaatctccacccattagctttaccctgacatcaggattgccaaatccaatggactcttgtctattcttacgtgacttctgctggaaaatgcgaatgttgaccatcctgccacttggaactctcttcccactcctcacattgcttttgctaccactggaagttccttctgtttcttgtggagtaccttttgctgtctgggacttgtagataatggtgtttcctagggctccctccagggccctctgcctcactaactggatatacttttcctgagcaaatcccaggaaacttgcgtcagaccgtgacttcaaatacaggttgataaatgctaaactgtctccaaaccagacttcatcctagcctccacacccagacacccaactgctatggatcaactttttagaatatcctcacttcaaactgaccttacctaaaataatgactttttcccccaataattgcccctgctatattccttatttctgaatggtacctcctagctatatagattatctgaggagcttactgaaatgctgattctgaagataaggggcatggctttaagattctgtatttctggcgagtacccaactggtgctcatgctgctgattgagaaccacttctgaatatagcaaggctgtaaattatccactacgtgccctcgtaattgtcttagttcaagcccagattattgtagtagacttagtatttctttgccttagttgatctgtgacccctccaatatctattccacactgttgcctaagtggccttagtaaaattcaagtctggttattttattcccctgcttggaatttctcaatgtagaatgaaactcattcagcattaacacataggcccttcttgatctgacatcgtgtttctctagttagactaaagaatccccactatgaagttgtttcatccgtaagtacctttgaacccagaagccccctttctcatatgtttctcattcctgtttgcccttcagagttcagctttagttgctaaaacattcagacatccctctgacttagatcccccactactgtttttctgtgagaagcagctatgcataattcctcttcaacacagtagttcttgaaattttgcaggcctctcctggaaaggaggaaatgacttctctgactttgtatgatgcttatttgtggatgaatgggcaagggaaaaaatgaaggaacaagtgaatgaacagtatgggagtatgagaaaaggtataaattgggtatagttgagaaaaggattcaaattgatctttggttcgagagacaatttcatctttctgatgaatttaaagtgtagtctttgaaccagctgggcttaattatgtaaagttttgagcctgagataagcacacaatcacaaaacctacccaaacaagttttttgtttcacttcatctcttataaaacaatgttctaaagtaagtgatagggatgctcatcattctgctacctattatcacaatgaaaacaatcataaatagtacacaggaaaggtgagaaatagcggatagttcttatttcatagtactgtatatggaaataaaccaaatttgctcatagagatactattttattacctcaaaaatatataaaaatgaaaacgttatgaaaatattttaaaatgggatttaaaaataattgagaacatcacagcaatttagaatactaaagagcatagctttaaaatgatagtgctgagaactccccacctctaccccaccacctgtaggcttctttgacaacttacaaatgttctctagtttgtatctagaatcacttatatctttcaaataaaccaactttgtgaa

SEQ ID NO: 129903 - DNA, 4623 bp, Homo sapiens
  Payload ID: 5413
  Gene Symbol: EZH1
  Gene Name: enhancer of zeste 1 polycomb repressive complex 2 subunit
  Uniprot ID: Q92800
  ENST ID: ENST00000428826
  CDS Start-End: 123-2366
cccgcggctcgggatggaggctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagtgtaccatagagagcattttcccgggatttgcaagccaacatatgttaatgaggtcactgaacacagttgcattggttcccatcatgtattcctggtcccctctccaacagaactttatggtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatcca

SEQ ID NO: 129904 - DNA, 4608 bp, Homo sapiens
  Payload ID: 5413
  Gene Symbol: EZH1
  Gene Name: enhancer of zeste 1 polycomb repressive complex 2 subunit
  ENST ID: ENST00000415827
  CDS Start-End: 135-2351
ctagcagcgggacccgcggctcgggatggaggctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagccttgtaccatagagagcattttcccgggatttgcaagccaacatatgttaatgaggtcactgaacacagttgcattggttcccatcatgtattcctggtcccctctccaacagaactttatggtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatcca

SEQ ID NO: 129905 - DNA, 1022 bp, Homo sapiens
  Payload ID: 5413
  Gene Symbol: EZH1
  Gene Name: enhancer of zeste 1 polycomb repressive complex 2 subunit
  ENST ID: ENST00000586382
  CDS Start-End: 133-1022
agcagcgggacccgcggctcgggatggaggctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctggaaggagcaaagga

SEQ ID NO: 129906 - DNA, 2392 bp, Homo sapiens
  Payload ID: 5413
  Gene Symbol: EZH1
  Gene Name: enhancer of zeste 1 polycomb repressive complex 2 subunit
  Uniprot ID: Q92800
  ENST ID: ENST00000590078
  CDS Start-End: 212-2245
agcgggacccgcggctcgggatggaggctggacacctgttctgctgttgtgtcctgccattctcctgaagaacagaggcacactgtaaaacccaacacttccccttgcattctataaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagtgtaccatagagagcattttcccgggatttgcaagccaacatatgttaatgaggtcactgaacacagttgcattggttcccatcatgtattcctggtcccctctccaacagaactttatggtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccacggcagcacttatggtagcggcactgtcttggctttcgtgctcacaccactgctgctcgagtctcctgcactgtgtctcccacactgagaaaccccccaacccactccctctgtagtgaggcctctgccatg

SEQ ID NO: 129907 - DNA, 1031 bp, Homo sapiens
  Payload ID: 5413
  Gene Symbol: EZH1
  Gene Name: enhancer of zeste 1 polycomb repressive complex 2 subunit
  ENST ID: ENST00000586867
  CDS Start-End: 130-501
agcgggacccgcggctcgggatggaggctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagtgtaccatagagagcattttcccgggatttgcaagccaacatatgttaatgaggtcactgaacacagttgcattggttcccatcatgtattcctggtcccctctccaacagaactttatgagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctg

SEQ ID NO: 129908 - DNA, 580 bp, Homo sapiens
  Payload ID: 5413
  Gene Symbol: EZH1
  Gene Name: enhancer of zeste 1 polycomb repressive complex 2 subunit
  ENST ID: ENST00000586935
  CDS Start-End: 1-377
atgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctact

SEQ ID NO: 129909 - DNA, 535 bp, Homo sapiens
  Payload ID: 5413
  Gene Symbol: EZH1
  Gene Name: enhancer of zeste 1 polycomb repressive complex 2 subunit
  ENST ID: ENST00000592492
  CDS Start-End: 216-535
cccgcggctcgggatggaggctggacacctgttctgctgttgtgtcctgccattctcctgaagaacagaggcacactgtaaaacccaacacttccccttgcattctataagagatggggtttcaccatgttgcccaaggttgtctcaaatcactgggctcaagtagtgctctcacctcggcttcctaaagtgttggttttacagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagtgtaccatagagagcattttcccgggatttgcaagccaacatatgttaatgaggtcactgaacacagttgcatt

SEQ ID NO: 129910 - DNA, 559 bp, Homo sapiens
  Payload ID: 5413
  Gene Symbol: EZH1
  Gene Name: enhancer of zeste 1 polycomb repressive complex 2 subunit
  ENST ID: ENST00000586089
  CDS Start-End: 51-559
atgcgtcctagcagcgggacccgcggctcgggatggaggattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaaggtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgcc

SEQ ID NO: 129911 - DNA, 2501 bp, Homo sapiens
  Payload ID: 5413
  Gene Symbol: EZH1
  Gene Name: enhancer of zeste 1 polycomb repressive complex 2 subunit
  Uniprot ID: Q92800
  ENST ID: ENST00000592743
  CDS Start-End: 51-2294
atgcgtcctagcagcgggacccgcggctcgggatggaggattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagtgtaccatagagagcattttcccgggatttgcaagccaacatatgttaatgaggtcactgaacacagttgcattggttcccatcatgtattcctggtcccctctccaacagaactttatggtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtct

SEQ ID NO: 129912 - DNA, 2283 bp, Homo sapiens
  Payload ID: 5413
  Gene Symbol: EZH1
  Gene Name: enhancer of zeste 1 polycomb repressive complex 2 subunit
  ENST ID: ENST00000588897
  CDS Start-End: 130-381
agcgggacccgcggctcgggatggaggctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccacggcagcacttatggtagcggcactgtcttggctttcgtgctcacaccactgctgctcgagtctcctgcactgtgtctcccacactgagaaaccccccaacccactccctctgtagtgaggcctctgccatgtcca

SEQ ID NO: 129913 - DNA, 745 bp, Homo sapiens
  Payload ID: 5413
  Gene Symbol: EZH1
  Gene Name: enhancer of zeste 1 polycomb repressive complex 2 subunit
  ENST ID: ENST00000593214
  CDS Start-End: 247-745
cgggacccgcggctcgggatggaggagtctcactcttgttgcccaggccgcagtacaatggcgtgatctcagctcactgcaacctctgcctcccgggttcacatgattctcctgcctcagcctcccgagtagctgggattacagctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagtgtaccatagagagcattttcccgggatttgcaagccaacatatgttaatgaggtcactgaacacagttgcattggttcccatcatgtattcctggtcccctctccaacagaactttatggtagaagatgagacggttttgtgcaatattccctacatgggagatgaagtgaaagaagaagatgagacttttattgaggagctgatcaataactatgatgggaaagtccatggtgaagaagagatgatccctg

SEQ ID NO: 129914 - DNA, 2394 bp, Homo sapiens
  Payload ID: 5413
  Gene Symbol: EZH1
  Gene Name: enhancer of zeste 1 polycomb repressive complex 2 subunit
  Uniprot ID: Q92800
  ENST ID: ENST00000585893
  CDS Start-End: 124-2247
acccgcggctcgggatggaggctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaaggtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccacggcagcacttatggtagcggcactgtcttggctttcgtgctcacaccactgctgctcgagtctcctgcactgtgtctcccacactgagaaaccccccaacccactccctctgtagtgaggcctctgccatg

SEQ ID NO: 129915 - DNA, 819 bp, Homo sapiens
  Payload ID: 5413
  Gene Symbol: EZH1
  Gene Name: enhancer of zeste 1 polycomb repressive complex 2 subunit
  ENST ID: ENST00000588239
  CDS Start-End: 1-154
aacaagaaagagaaagcgacatgctattgaaggcaacaaaaagagttccaagaaacagttcccaaatgacatgatcttcagtgcaattgcctcaatgttccctgagaatggtgtcccagatgacatgaaggagagcttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatca

SEQ ID NO: 129916 - DNA, 2477 bp, Homo sapiens
  Payload ID: 5414
  Gene Symbol: EZH2
  Gene Name: enhancer of zeste 2 polycomb repressive complex 2 subunit
  Uniprot ID: Q15910
  ENST ID: ENST00000350995
  CDS Start-End: 93-2216
agaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggaggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttg

SEQ ID NO: 129917 - DNA, 2639 bp, Homo sapiens
  Payload ID: 5414
  Gene Symbol: EZH2
  Gene Name: enhancer of zeste 2 polycomb repressive complex 2 subunit
  Uniprot ID: Q15910
  ENST ID: ENST00000320356
  CDS Start-End: 123-2378
tccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttg

SEQ ID NO: 129918 - DNA, 2522 bp, Homo sapiens
  Payload ID: 5414
  Gene Symbol: EZH2
  Gene Name: enhancer of zeste 2 polycomb repressive complex 2 subunit
  Uniprot ID: Q15910
  ENST ID: ENST00000478654
  CDS Start-End: 173-2260
cgcgccgctgcgggcggcccggccggcggggctccgggagtgcgaaccgggcggcggcggcggcgccaggacctccccgccactgctgtgccggtcccggggttactttttgaaagcgggaggaatcgagaagcacgatcttttggaaaacttggtgaacgcctaaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaagggtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgt

SEQ ID NO: 129919 - DNA, 3641 bp, Homo sapiens
  Payload ID: 5414
  Gene Symbol: EZH2
  Gene Name: enhancer of zeste 2 polycomb repressive complex 2 subunit
  ENST ID: ENST00000492143
  CDS Start-End: 128-1132
ctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttgccactcctacctaggaactaaatgggtatatattgcctgttggattttggacagaagattcattgaatggcacctgcagaaggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctggtaagacacgtctaataactgggttttactgttctgtgaaagttcgtgttgtgaggattaaggatgtataatgcattgaataattttcttagttggttagtttcagtataaagaccagagttatctcaagaatgtgtagctgtgttgtttctgtttcctgcctgcacccgtaccctagcttgtggtgtttgccctgcttggttgtttgaaagctgatgatgcactttattctcattctttgtgccattttcttttttcgatctttctcaggtagggaataatgaaatttggatcatttggtttaatattcttgacgttctgtgagtagttttgttggaaaatgtgaactacgatgggttagtgttttgccgattggatttgagttgtcctcatcttttcgcttttttcttaagcacaccctgaattgtacttcttaatattatttccaatcatttcttgaccagtgcttacatttggttttgtagaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtaagatatccgataaaaatgttgttaaaagagcttcaaacatagagataaaactgtactcgttgtccaaacaaagaaaattcttggttattactaagctcctattcatctcctaaaaataatttttttttcttcccaagagggaattgaatgaaaattattctccaggtatgttacagaatttccccaatgtagacttttaaggttagatagcagtagcttttaaaagctagtaagaattgaaatttagcatcacagttcttgaccagaatataattacagctacccctaatgtgagggtagggacagcgatgtgtgttatatccccagcatctagcagtgtcacagaagagacaaagacatttttctggtatgcatgagtataagaatggtttgcctaaataagactgtcctcatggctctgtgactgtgcctcttgtcaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtc

SEQ ID NO: 129920 - DNA, 1491 bp, Homo sapiens
  Payload ID: 5414
  Gene Symbol: EZH2
  Gene Name: enhancer of zeste 2 polycomb repressive complex 2 subunit
  ENST ID: ENST00000483012
  CDS Start-End: 166-600
aaataaaagcgatggcgattgggctgccgcgtttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggaggccattcacctgctcttccctctacgattttccataacacagtttttacttggaaccagccttctgccaagagtctcagtttggttgtgtactcctacaactactatttttggcttgacttccctctccagctcccagtggtccagccacacagtcgcctattgtaccagctggttgattgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttgccactcctacctaggaactaaatgggtatatattgcctgttggattttggacagaagattcattgaatggcacctgcagaaggagggagcaaaggagtttgctgctgctctcaccgctgagcggataaagaccccaccaaaacgtccaggaggccgcagaaga

SEQ ID NO: 129921 - DNA, 2572 bp, Homo sapiens
  Payload ID: 5414
  Gene Symbol: EZH2
  Gene Name: enhancer of zeste 2 polycomb repressive complex 2 subunit
  Uniprot ID: Q15910
  ENST ID: ENST00000476773
  CDS Start-End: 321-2408
gacgacgttcgcggcggggaactcggagtagcttcgcctctgacgtttccccacgacgcaccccgaaatccccctgagctccggcggtcgcgggctgccctcgccgcctggtctggctttatgctaagtttgagggaagagtcgagctgctctgctctctattgattgtgtttctggagggcgtcctgttgaattcccacttcattgtgtacatccccttccgttccccccaaaaatctgtgccacagggttactttttgaaagcgggaggaatcgagaagcacgatcttttggaaaacttggtgaacgcctaaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaagggtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattg

SEQ ID NO: 129922 - DNA, 2591 bp, Homo sapiens
  Payload ID: 5414
  Gene Symbol: EZH2
  Gene Name: enhancer of zeste 2 polycomb repressive complex 2 subunit
  Uniprot ID: Q15910
  ENST ID: ENST00000460911
  CDS Start-End: 90-2330
aggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttg

SEQ ID NO: 129923 - DNA, 2466 bp, Homo sapiens
  Payload ID: 5414
  Gene Symbol: EZH2
  Gene Name: enhancer of zeste 2 polycomb repressive complex 2 subunit
  Uniprot ID: Q15910
  ENST ID: ENST00000483967
  CDS Start-End: 132-2345
ggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgta

SEQ ID NO: 129924 - DNA, 1579 bp, Homo sapiens
  Payload ID: 5415
  Gene Symbol: ENKD1
  Gene Name: enkurin domain containing 1
  Uniprot ID: Q9H0I2
  ENST ID: ENST00000243878
  CDS Start-End: 323-1363
cggaagccacggttgcccggcaacaacaagtcccgtcgggtggcagcggctggcggcaaaacctctcgagtgagcccctgcccgagtgccgcgggggagaggccgcgagcgggaccgagaagtgggctgggagcagaggtcgcggaggtggcgagcgaggccggggcccaggcggggaccggcaggggcccgggagtggcgggcacgccagggtcagggtgccgggcgagggagggggcccggggttggggaagggggcccggggagggaggtaaacagccctgcaggcctcggggcaccgttgctgggcggcgccggcggcatgtgcgagggcccgtcccgcatctcggggcccatccccccagacccgacgctctgtcctgacaactacaggcggccgacctcggctcaagggcgcctcgagggaaacgcgctgaagctggacttgctgacttccgaccgggccctggacaccaccgctccccgtggcccctgcatcggtcccggtgccggagagatcctggagcgcggccagcgcggcgtcggggacgtgctgttgcaactcgaggggatctccctaggtcctggggcctctctcaagaggaaggaccctaaggaccatgagaaggagaacctgaggcggatcagggagattcagaagcgcttcagagaacaggagcgcagccgggagcagggccagcccaggcccctgaaagctctgtggcgctcacccaagtacgacaaggtggagtcccgggtcaaggcccagctccaggagcctggccctgcctctgggacagagtctgcccacttcctgcgggcgcactcccgctgcggccctggcctcccaccaccccatgtatctagtccccagccaaccccaccaggtcccgaagctaaggagccaggcctgggggtggacttcattcgtcacaatgcacgagctgccaagagagccccccggaggcattcctgctcactgcaggtcctggcacaagtgctagagcagcagcggcaggcccaggagcactacaatgccacgcagaagggccatgtgccacattacttgttggagcgcagggacctgtggcggcgggaggccgaggcccgcaagcagagccagccggaccctgccatgcccccaggccacacgcgcatgcctgagaaccagcggctggaaacactgaccaagctgctccagagccagagccagctgctgcgtgagctggtactgctgcctgctggggcagactcactgagagcccagagccaccgtgctgagctggaccggaagctggtgcaggtagaggaggccatcaagatcttttctcggcccaaagtcttcgtgaagatggacgactgagcccctttgggggacagtggcaaggagctccatgctgaggatcgccacatggctgcaaaggacagggttggacccaatcccagagcagaggtctgaagacaggagcaggggggtggccagtgtccctagagcactcttcccagtcaccagtggctgcagaagggccaccctagccttttaactgctttgtcaaaattaaacattttgtacacagga

SEQ ID NO: 129925 - DNA, 1353 bp, Homo sapiens
  Payload ID: 5415
  Gene Symbol: ENKD1
  Gene Name: enkurin domain containing 1
  ENST ID: ENST00000602644
  CDS Start-End: 286-963
gggtggcagcggctggcggcaaaacctctcgagtgagcccctgcccgagtgccgcgggggagaggccgcgagcgggaccgagaagtgggctgggagcagaggtcgcggaggtggcgagcgaggccggggcccaggcggggaccggcaggggcccgggagtggcgggcacgccagggtcagggtgccgggcgagggagggggcccggggttggggaagggggcccggggagggaggtaaacagccctgcaggcctcggggcaccgttgctgggcggcgccggcggcatgtgcgagggcccgtcccgcatctcggggcccatccccccagacccgacgctctgtcctgacaactacaggcggccgacctcggctcaagggcgcctcgagggaaacgcgctgaagctggacttgctgacttccgaccgggccctggacaccaccgctccccgtggcccctgcatcggtcccggtgccggagagatcctggagcgcggccagcgcggcgtcggggacgtgctgttgcaactcgaggggatctccctaggtcctggggcctctctcaagaggaaggaccctaaggaccatgagaaggagaacctgaggcggatcagggagattcagaagcgcttcagagaacaggagcgcagccgggagcagggccagcccaggcccctgaaagctctgtggcgctcacccaagtacgacaaggtggagtcccgggtcaaggcccagctccaggagcctggccctgcctctgggacagagtctgcccacttcctgcgggcgcactcccgctgcggccctggcctcccaccaccccatgtatctagtccccagccaaccccaccaggtcccgaagctaagcttgttggagcgcagggacctgtggcggcgggaggccgaggcccgcaagcagagccagccggaccctgccatgcccccaggccacacgcgcatgcctgagaaccagcggctggaaacactgaccaagctgctccagagccagagccagctgctgcgtgagctggtactgctgcctgctggggcagactcactgagagcccagagccaccgtgctgagctggaccggaagctggtgcaggtagaggaggccatcaagatcttttctcggcccaaagtcttcgtgaagatggacgactgagcccctttgggggacagtggcaaggagctccatgctgaggatcgccacatggctgcaaaggacagggttggacccaatcccagagcagaggtctgaagacaggagcaggggggtggccagtgtccctagagcactcttcccagtcaccagtggctgcagaagggccaccctagccttttaactgctttgtc

SEQ ID NO: 129926 - DNA, 266 bp, Homo sapiens
  Payload ID: 5415
  Gene Symbol: ENKD1
  Gene Name: enkurin domain containing 1
  ENST ID: ENST00000602409
  CDS Start-End: 1-266
cggggacgtgctgttgcaactcgaggggatctccctaggtcctggggcctctctcaagaggaaggaccctaaggaccatgagaaggagaacctgaggcggatcagggagattcagaagcgcttcagagaacaggagcgcagccgggagcagggccagcccaggcccctgaaagctctgtggcgctcacccaagtacgacaaggtggagtcccgggtcaaggcccagctccaggagccaggcctgggggtggacttcattcgtcaca

SEQ ID NO: 129927 - DNA, 3382 bp, Homo sapiens
  Payload ID: 5416
  Gene Symbol: ENKUR
  Gene Name: enkurin, TRPC channel interacting protein
  Uniprot ID: Q8TC29
  ENST ID: ENST00000331161
  CDS Start-End: 221-991
agtcaacgacgcttagcaatccggagagaaatagggtgttttcttcccgagagaggactgctaagagggggttaaagggggacgatgtgaaggagagaacctgtggtccttcagaaggcgaagaagaaagaaaggggaagcagtgaagaaagggacggagatactgggacagggagaaaaaagttgtggagagtagcttttaaggagtcatttggtggccatggatccaacgtgctcttctgagtgcatttataacctcatacccagtgacttgaaggagcctccccagcctcctaggtacatatccatttttaaggcaactgtaaaagatgacatgcaaaaagctaaaactgcaatgaaaactatgggaccagcaaaagttgaagtaccttctccaaaggatttcctaaagaaacattcaaaggaaaaaactctaccacccaaaaaaaactttgatcggaacgtgcccaaaaagcctgctgtgccattgaagactgatcatcctgtcatgggaatacagagtggaaaaaattttataaatacaaatgcagctgatatcatcatgggagtggctaaaaagcctaaaccaatttatgttgataaaagaactggagacaagcatgatcttgagccttcaggactagttccaaagtacatcaataaaaaggattatggtgtcacacctgaatacatatgtaagcgaaacgaggaaataaagaaagcccaagaagactatgatcgttatatccaggaaaaccttaagaaagcagctatgaaaaggctctccgatgaagaaagggaggcagttttgcaggggctgaaaaagaactgggaagaggtgcataaagaattccagtccctctcggtctttatagattctataccaaagaagatccgcaagcagaggctggaagaagaaatgaaacaactagaacacgacattggcataattgaaaagcacaagattatttatattgccaataacgcatgataccaacagcacaactttgaaaactgttaagtattttgaactggaaatagtaacacgtgccttcttgctactctaaactgtctccaacacattgtttctgagctccacaaatgcaaaagatgtattttcctgtggcccatgacatttgcagttattcccagtgagaaatattttcagtattcgtaacactgtatatgatgaaaggcttctatttggaggaagaaaaattaagaagacaacttacaaaatcaagatgacaacttataaaggcatcattgaggatgattaaggagaatagcctcctttctagcataccaacctcgatactcttattttattccacaactcactatgcatatcttatttaaatgtttttttccttttggtcctttctacttatctattttgtgaattctaaagttacatttgtaagattacataatctattaagcaataagtttatgttagtagagctgttttcaacccaaaaataagaaaaaatagctctaaatatctaaaaggaaaaggttattttatgaaattttaaattagaaaaatttggtaaaatatatgcaactataaaatatcagagaaataacaatttctactgcttacactggtttttatcctctggacaacataaaaaacaaaatatgggagtctttcaggcttttttcacaaacacagaatttggaagccttatagaaaagcttattttggttacttaaagaaaagtagtttatatacaattattttttgaaaattcacttgaaacttgtccatatgagtatctttattcctttattaacttagggcagatataaaataaaggataatatatgacaaattctcacttaccaagaatggttggttgctatttagggtaggctaacagctgtgacagtacactccaaaatgtataattacgtaaacacatattcaattcttgctaacatagcagtactttgctgtgagcaggtcagcaggaacccttttctgcagtcactcagggacccagacttacagagtgggtaggatgcatctgatccagagttagggagaggcacgtacaggccaggcctagaaatgatgcatatcattcccgtttgcatcgctaagtaagcaacttaagttgctttaacaaactaactccaaatctcagtttcctgataaagatacatttttcatttacatcactgtgcaatgtgactaagggtaggggtataagtctgttccatgcagtcactcagggacccagtctccttttgtctggtgactctgttgatccaggcagtctttctctgccaattcaggatgagatgtttaggtaagtattttatttgtgaaatgattgctatacatactcatttttaaataattcaaaatcagtagcaatgcaaaaatattctgattactttagccttatggatattatgctttgaagtcatgagtgggagttgccttaaatgttaaaatgaaaactttgtggttttaacagctaattcttttgctttctgtaaatgtctactaaagaatctagacttttctctatggtctacagtgttgtcctagatgaacattgttgcctttctttcacagagccttcagagggaaacattcccatccattgttcctggaaaggtgatccctaccacgggatcccaaacttggatagagccagttcaacctcccccaatccatacacatacatacctaggtcatcctatcacccaaaagagggacaaacatctgacttggacagctgaccagtgactgatcagattctctctctcttgagagcatgaattaagagacatggagactgcagtcacttgggagtagacacctgaaactaaaaagtcaaacttcattatgcagctagtttgacttggtttctcttcctgttcaaaggaagaatgggtagaataaagatttgatgtggtctggccccttgtctatgatctttttagcttgatttcttgaaatgctgcttcttccctacccactgtaactggcattcccatagtactgaggtactagagacctctgagatctgcacacatggttccctccacccagaaaactgcccttttctttctctcatcctacatagctgcctggcaaatccctagtcttcatcagctcacatcacatttccatgacaatcccctttgattcctcagaatctggccttcctttatagcactggtcatattgtattgtgcatatctggttatttgcctgttttccatgaacatttcaagcttatgggggagaagacactgtatacattttcatctgcattccttagaatctgcataacagctggtatagagaaggtactcaaaaaatccttaatgaataaagtaatggatcgtacccaaacatgta

SEQ ID NO: 129928 - DNA, 1318 bp, Homo sapiens
  Payload ID: 5416
  Gene Symbol: ENKUR
  Gene Name: enkurin, TRPC channel interacting protein
  ENST ID: ENST00000376363
  CDS Start-End: 221-988
agtcaacgacgcttagcaatccggagagaaatagggtgttttcttcccgagagaggactgctaagagggggttaaagggggacgatgtgaaggagagaacctgtggtccttcagaaggcgaagaagaaagaaaggggaagcagtgaagaaagggacggagatactgggacagggagaaaaaagttgtggagagtagcttttaaggagtcatttggtggccatggatccaacgtgctcttctgagtgcatttataacctcatacccagtgacttgaaggagcctccccagcctcctaggtacatatccatttttaaggcaactgtaaaagatgacatgcaaaaagctaaaactgcaatgaaaactatgggaccagcaaaagttgaagtaccttctccaaaggatttcctaaagaaacattcaaaggaaaaaactctaccacccaaaaaaaactttgatcggaacgtgcccaaaaagcctgctgtgccattgaagactgatcatcctgtcatgggaatacagagtggaaaaaattttataaatacaaatgcagctgatatcatcatgggagtggctaaaaagcctaaaccaatttatgttgataaaagaactggagacaagcatgatcttgagccttcaggactagttccaaagtacatcaataaaaaggattatggtgtcacacctgaatacatatgtaagcgaaacgaggaaataaagaaagcccaagaagactatgatcgttatatccaggaaaaccttaagaaagcagctatgaaaaggctctccgatgaagaaagggaggcagttttgcaggggctgaaaaagaactgggaagaggtgcataaagaattccagtccctctcggtctttatagattctataccaaagaagatccgcaagcagaggctggaagaagaaatgaaacaactagaacacgacattggcataattgaaaagcacaagattatttatattgccaataagtaagaatggatctttaaagtataacaatttcaatgtaggggaaaaaaacatggaaaatataaaaaactccaagtttttcaaaaaggaaaatactatgaagagaataaaaatagtcttaatcagaatgcttaggcaatatgcaaagaataattgagttattcacttacacaagaagaaattttgtttttactagtgtcacgttttccacatataaactattaaatttgagaatatgtgttccagttccacaatgtaattcattattattatgtacttgtttcacataaacattaatttctaggtcctgaaaaataaagtcagcactcagaactt

SEQ ID NO: 129929 - DNA, 1947 bp, Homo sapiens
  Payload ID: 5416
  Gene Symbol: ENKUR
  Gene Name: enkurin, TRPC channel interacting protein
  Uniprot ID: Q8TC29
  ENST ID: ENST00000496261
  CDS Start-End: 225-995
gcacagtcaacgacgcttagcaatccggagagaaatagggtgttttcttcccgagagaggactgctaagagggggttaaagggggacgatgtgaaggagagaacctgtggtccttcagaaggcgaagaagaaagaaaggggaagcagtgaagaaagggacggagatactgggacagggagaaaaaagttgtggagagtagcttttaaggagtcatttggtggccatggatccaacgtgctcttctgagtgcatttataacctcatacccagtgacttgaaggagcctccccagcctcctaggtacatatccatttttaaggcaactgtaaaagatgacatgcaaaaagctaaaactgcaatgaaaactatgggaccagcaaaagttgaagtaccttctccaaaggatttcctaaagaaacattcaaaggaaaaaactctaccacccaaaaaaaactttgatcggaacgtgcccaaaaagcctgctgtgccattgaagactgatcatcctgtcatgggaatacagagtggaaaaaattttataaatacaaatgcagctgatatcatcatgggagtggctaaaaagcctaaaccaatttatgttgataaaagaactggagacaagcatgatcttgagccttcaggactagttccaaagtacatcaataaaaaggattatggtgtcacacctgaatacatatgtaagcgaaacgaggaaataaagaaagcccaagaagactatgatcgttatatccaggaaaaccttaagaaagcagctatgaaaaggctctccgatgaagaaagggaggcagttttgcaggggctgaaaaagaactgggaagaggtgcataaagaattccagtccctctcggtctttatagattctataccaaagaagatccgcaagcagaggctggaagaagaaatgaaacaactagaacacgacattggcataattgaaaagcacaagattatttatattgccaataacgcatgataccaacagcacaactttgaaaactgttaagtattttgaactggaaatagtaacacgtgccttcttgctactctaaactgtctccaacacattgtttctgagctccacaaatgcaaaagatgtattttcctgtggcccatgacatttgcagttattcccaagccttcagagggaaacattcccatccattgttcctggaaaggtgatccctaccacgggatcccaaacttggatagagccagttcaacctcccccaatccatacacatacatacctaggtcatcctatcacccaaaagagggacaaacatctgacttggacagctgaccagtgactgatcagattctctctctcttgagagcatgaattaagagacatggagactgcagtcacttgggagtagacacctgaaactaaaaagtcaaacttcattatgcagctagtttgacttggtttctcttcctgttcaaaggaagaatgggtagaataaagatttgatgtggtctggccccttgtctatgatctttttagcttgatttcttgaaatgctgcttcttccctacccactgtaactggcattcccatagtactgaggtactagagacctctgagatctgcacacatggttccctccacccagaaaactgcccttttctttctctcatcctacatagctgcctggcaaatccctagtcttcatcagctcacatcacatttccatgacaatcccctttgattcctcagaatctggccttcctttatagcactggtcatattgtattgtgcatatctggttatttgcctgttttccatgaacatttcaagcttatgggggagaagacactgtatacattttcatctgcattccttagaatctgcataacagctggtatagagaaggtactcaaaaaatccttaatgaataaagtaatggatcgtacccaaacatgta

SEQ ID NO: 129930 - DNA, 542 bp, Homo sapiens
  Payload ID: 5416
  Gene Symbol: ENKUR
  Gene Name: enkurin, TRPC channel interacting protein
  ENST ID: ENST00000483339
  CDS Start-End: 167-542
cttttaaggagtcatttggtggccatggatccaacgtgctcttctgagtgcatttataacctcatacccagtgacttgaaggagcctccccagcctcctagaaaaaaactttgatcggaacgtgcccaaaaagcctgctgtgccattgaagactgatcatcctgtcatgggaatacagagtggaaaaaattttataaatacaaatgcagctgatatcatcatgggagtggctaaaaagcctaaaccaatttatgttgataaaagaactggagacaagcatgatcttgagccttcaggactagttccaaagtacatcaataaaaaggattatggtgtcacacctgaatacatatgtaagcgaaacgaggaaataaagaaagcccaagaagactatgatcgttatatccaggaaaaccttaagaaagcagctatgaaaaggctctccgatgaagaaagggaggcagttttgcaggggctgaaaaagaactgggaagaggtgcataaagaattccagtccctctcggtctttatagattctatac

SEQ ID NO: 129931 - DNA, 3294 bp, Homo sapiens
  Payload ID: 5416
  Gene Symbol: ENKUR
  Gene Name: enkurin, TRPC channel interacting protein
  ENST ID: ENST00000615958
  CDS Start-End: 320-904
cccttaagagaggaacactggtggaaaagtgacaagagagcaacaagtcctacttgctcaagaagagaatgactcaatacgcaggattaggcttatagagcccatgaagcaaaatggaacagaaggagctgcacccaacagagcaggcggctggaggagcggcacaagaaagcctgggataaagttgattttccatatctggatgtgtctggcagcatcaaccatatagctgcaaaccagggtcgatttcaaagcccagggcctggccacacgtgtccaacacctatgaacttcttatggagattgttcaccacggagcatgaagacagagcgggtgactggaggtggctccccagaaaaaaactttgatcggaacgtgcccaaaaagcctgctgtgccattgaagactgatcatcctgtcatgggaatacagagtggaaaaaattttataaatacaaatgcagctgatatcatcatgggagtggctaaaaagcctaaaccaatttatgttgataaaagaactggagacaagcatgatcttgagccttcaggactagttccaaagtacatcaataaaaaggattatggtgtcacacctgaatacatatgtaagcgaaacgaggaaataaagaaagcccaagaagactatgatcgttatatccaggaaaaccttaagaaagcagctatgaaaaggctctccgatgaagaaagggaggcagttttgcaggggctgaaaaagaactgggaagaggtgcataaagaattccagtccctctcggtctttatagattctataccaaagaagatccgcaagcagaggctggaagaagaaatgaaacaactagaacacgacattggcataattgaaaagcacaagattatttatattgccaataacgcatgataccaacagcacaactttgaaaactgttaagtattttgaactggaaatagtaacacgtgccttcttgctactctaaactgtctccaacacattgtttctgagctccacaaatgcaaaagatgtattttcctgtggcccatgacatttgcagttattcccagtgagaaatattttcagtattcgtaacactgtatatgatgaaaggcttctatttggaggaagaaaaattaagaagacaacttacaaaatcaagatgacaacttataaaggcatcattgaggatgattaaggagaatagcctcctttctagcataccaacctcgatactcttattttattccacaactcactatgcatatcttatttaaatgtttttttccttttggtcctttctacttatctattttgtgaattctaaagttacatttgtaagattacataatctattaagcaataagtttatgttagtagagctgttttcaacccaaaaataagaaaaaatagctctaaatatctaaaaggaaaaggttattttatgaaattttaaattagaaaaatttggtaaaatatatgcaactataaaatatcagagaaataacaatttctactgcttacactggtttttatcctctggacaacataaaaaacaaaatatgggagtctttcaggcttttttcacaaacacagaatttggaagccttatagaaaagcttattttggttacttaaagaaaagtagtttatatacaattattttttgaaaattcacttgaaacttgtccatatgagtatctttattcctttattaacttagggcagatataaaataaaggataatatatgacaaattctcacttaccaagaatggttggttgctatttagggtaggctaacagctgtgacagtacactccaaaatgtataattacgtaaacacatattcaattcttgctaacatagcagtactttgctgtgagcaggtcagcaggaacccttttctgcagtcactcagggacccagacttacagagtgggtaggatgcatctgatccagagttagggagaggcacgtacaggccaggcctagaaatgatgcatatcattcccgtttgcatcgctaagtaagcaacttaagttgctttaacaaactaactccaaatctcagtttcctgataaagatacatttttcatttacatcactgtgcaatgtgactaagggtaggggtataagtctgttccatgcagtcactcagggacccagtctccttttgtctggtgactctgttgatccaggcagtctttctctgccaattcaggatgagatgtttaggtaagtattttatttgtgaaatgattgctatacatactcatttttaaataattcaaaatcagtagcaatgcaaaaatattctgattactttagccttatggatattatgctttgaagtcatgagtgggagttgccttaaatgttaaaatgaaaactttgtggttttaacagctaattcttttgctttctgtaaatgtctactaaagaatctagacttttctctatggtctacagtgttgtcctagatgaacattgttgcctttctttcacagagccttcagagggaaacattcccatccattgttcctggaaaggtgatccctaccacgggatcccaaacttggatagagccagttcaacctcccccaatccatacacatacatacctaggtcatcctatcacccaaaagagggacaaacatctgacttggacagctgaccagtgactgatcagattctctctctcttgagagcatgaattaagagacatggagactgcagtcacttgggagtagacacctgaaactaaaaagtcaaacttcattatgcagctagtttgacttggtttctcttcctgttcaaaggaagaatgggtagaataaagatttgatgtggtctggccccttgtctatgatctttttagcttgatttcttgaaatgctgcttcttccctacccactgtaactggcattcccatagtactgaggtactagagacctctgagatctgcacacatggttccctccacccagaaaactgcccttttctttctctcatcctacatagctgcctggcaaatccctagtcttcatcagctcacatcacatttccatgacaatcccctttgattcctcagaatctggccttcctttatagcactggtcatattgtattgtgcatatctggttatttgcctgttttccatgaacatttcaagcttatgggggagaagacactgtatacattttcatctgcattccttagaatctgcataacagctggtatagagaaggtactcaaaaaatccttaatgaataaagtaatggatcgtacccaaacatgt

SEQ ID NO: 129932 - DNA, 1783 bp, Homo sapiens
  Payload ID: 5417
  Gene Symbol: ENO1
  Gene Name: enolase 1, (alpha)
  Uniprot ID: P06733
  ENST ID: ENST00000234590
  CDS Start-End: 121-1425
ggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgagaa

SEQ ID NO: 129933 - DNA, 647 bp, Homo sapiens
  Payload ID: 5417
  Gene Symbol: ENO1
  Gene Name: enolase 1, (alpha)
  ENST ID: ENST00000497492
  CDS Start-End: 63-647
gcttagcacagcgggagttgggagtggaagttgcttttccatcgtagccaagtaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtc

SEQ ID NO: 129934 - DNA, 732 bp, Homo sapiens
  Payload ID: 5417
  Gene Symbol: ENO1
  Gene Name: enolase 1, (alpha)
  ENST ID: ENST00000489867
  CDS Start-End: 680-732
agcgccccaaccccggagtggggccgaggcgcgcagcctctcaacgactcgacgccaacggggtctctcggatcgcggcgcgaggcaggaggggcggggcaggagggccgcggcaggcccgggccgccaaagttgtcagcaaggtcgagggccggacgtggggccccagagcgacgctgagtgcgtgcgggactcggagtacgtgacggagccccgagctctcatgcccgccacgccgccccgggccatcccccggagccccggctccgcacaccccagttcggctcaccggtcctatctggggccagagtttcgcccgcaccactacagggccgctggggagtcggggccccccagatctgcccgcctcaagtccgcgggacgtcacccccctttccacgctactgcagccgtcgcagtcccacccctttccgggaggtgagggaatgagtgacggctctcccgacgaatggcgaggcggagctgagggggcgtgccccggaggcgggaagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcc

SEQ ID NO: 129935 - DNA, 2423 bp, Homo sapiens
  Payload ID: 5418
  Gene Symbol: ENO2
  Gene Name: enolase 2 (gamma, neuronal)
  Uniprot ID: P09104
  ENST ID: ENST00000229277
  CDS Start-End: 223-1527
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgc

SEQ ID NO: 129936 - DNA, 2827 bp, Homo sapiens
  Payload ID: 5418
  Gene Symbol: ENO2
  Gene Name: enolase 2 (gamma, neuronal)
  Uniprot ID: P09104
  ENST ID: ENST00000535366
  CDS Start-End: 627-1931
ctcttcacttcccgctgcaacccccagggactgcagggcctttctcaggaccctcttccccgacacctgtattgcatgcgcctttcgcgggaagaggagggatacacgtttgggagagagtgggaccttggggaaggggcagtgttcaggcagctggggtgttaagttggggaggtatgggggctctggaagagaggcccaggcagcccatcctcttcttggctcccaggagaaatgcaagcctggcagccattccgctctgaggagatctgggggaaccccaccggctggccaagctgcaaagaggcgcgggaaccactgtcgtgcccctcccctcctcactgcagtgttctcccatctcatcatttgatcttaccccgccccccactgcagtgacctccccttcctcactgcattgaccttctcctcttcccaggggggagggggaatcccttctacagccctagactgcagccagcgcctccctacccaccccccacccactgcagtaacctctttcccatccctcccagcctcccgccccgcccattgatctcaggctccacccctctaagcctcttatctttctccttccttcccttccacccgaggagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgc

SEQ ID NO: 129937 - DNA, 1911 bp, Homo sapiens
  Payload ID: 5418
  Gene Symbol: ENO2
  Gene Name: enolase 2 (gamma, neuronal)
  ENST ID: ENST00000545045
  CDS Start-End: 66-1013
ccaccgccaccgccaccgccactaccaccgtctgagtctgcagtcccgaggagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgcac

SEQ ID NO: 129938 - DNA, 2549 bp, Homo sapiens
  Payload ID: 5418
  Gene Symbol: ENO2
  Gene Name: enolase 2 (gamma, neuronal)
  Uniprot ID: P09104
  ENST ID: ENST00000541477
  CDS Start-End: 349-1653
ctgttactgtcgagtgggtcgggccgtgggtatgagcgcttgtgtgcgctggggccaggtcgtgggtgcccccacccttcccccatcctcctcccttccccactccaccctcgtcggtcccccacccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgaggagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgc

SEQ ID NO: 129939 - DNA, 1646 bp, Homo sapiens
  Payload ID: 5418
  Gene Symbol: ENO2
  Gene Name: enolase 2 (gamma, neuronal)
  Uniprot ID: P09104
  ENST ID: ENST00000538763
  CDS Start-End: 87-1262
gctctctcagcgccgccgtcgccaccgccaccgccaccgccactaccaccgtctgagtctgcagtcccgaggagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaagccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgt

SEQ ID NO: 129940 - DNA, 547 bp, Homo sapiens
  Payload ID: 5418
  Gene Symbol: ENO2
  Gene Name: enolase 2 (gamma, neuronal)
  ENST ID: ENST00000537688
  CDS Start-End: 238-547
agtagaaacggggtttcaccacgttagccaggatggtctggatctcctgacctcgtgatctgcccgcctccgccttccaaagtgctgggattacaggggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaat

SEQ ID NO: 129941 - DNA, 724 bp, Homo sapiens
  Payload ID: 5418
  Gene Symbol: ENO2
  Gene Name: enolase 2 (gamma, neuronal)
  ENST ID: ENST00000535275
  CDS Start-End: 1-222
ctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgggaataaaggggcatgttcctgcctgatgtagagacccagggaagatgaacacctcccccctccccaccatgctctctctgcagtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgct

SEQ ID NO: 129942 - DNA, 416 bp, Homo sapiens
  Payload ID: 5418
  Gene Symbol: ENO2
  Gene Name: enolase 2 (gamma, neuronal)
  ENST ID: ENST00000543975
  CDS Start-End: 1-260
tggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctga

SEQ ID NO: 129943 - DNA, 1521 bp, Homo sapiens
  Payload ID: 5419
  Gene Symbol: ENO3
  Gene Name: enolase 3 (beta, muscle)
  Uniprot ID: P13929
  ENST ID: ENST00000323997
  CDS Start-End: 133-1437
gcgcagcctgagagggggtgagctgacactgtcccagctgccacctagactcggagctccatccaaacctccagcgaagacatcccaggtcgggtgaatcttccagccctgggggtggaggtagtaaaggccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaaga

SEQ ID NO: 129944 - DNA, 563 bp, Homo sapiens
  Payload ID: 5419
  Gene Symbol: ENO3
  Gene Name: enolase 3 (beta, muscle)
  ENST ID: ENST00000522798
  CDS Start-End: 120-563
acttattcaagtaataagaaagcaaagaagagtttggccaaatcctctagtcgctctcatagctgaaggcacccaccggggccacttctgtccccagcgtcttctcgggtcgtgcagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgcca

SEQ ID NO: 129945 - DNA, 561 bp, Homo sapiens
  Payload ID: 5419
  Gene Symbol: ENO3
  Gene Name: enolase 3 (beta, muscle)
  ENST ID: ENST00000522249
  CDS Start-End: 99-561
gacactgtcccagctgccacctagactcggagctccatccaaacctccagcgaagacatcccaggtcgggtgaatcttccagccctgggggtggagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacg

SEQ ID NO: 129946 - DNA, 945 bp, Homo sapiens
  Payload ID: 5419
  Gene Symbol: ENO3
  Gene Name: enolase 3 (beta, muscle)
  ENST ID: ENST00000519602
  CDS Start-End: 97-945
ataaatgcgcagcctgagagggggtgagctgacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagcttt

SEQ ID NO: 129947 - DNA, 1312 bp, Homo sapiens
  Payload ID: 5419
  Gene Symbol: ENO3
  Gene Name: enolase 3 (beta, muscle)
  ENST ID: ENST00000521659
  CDS Start-End: 67-243
gacactgtcccagctgccacctagactcggagctccatccaaacctccagcgaagacatcccagccatggccatgcagaaaatctttgcccgggaaatcttggactccaggggcaaccccacggtggaggtggacctgcacacggccaaggacttcttcccaagcccccttcttccaacgtggaaccagagctggaagctaggagaagcaggagtctctctctgcactgcctcctgtccctgagctcagagaggacacctcagccctttgagaggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctggtgaggcgttcgggtgtcccagtgttcctgcccgaatcccgtgcagctgcctaatatactgatttcagtgacctgctttgccatcgacttggatccttccaattcttagccccattaaaatccccatttaagctcttctgccctgtcacccctccatgaggctccttctgacctctagccgtgtctctgccctgtctctgccttgtctctgccctgtctctgctctgtctctgccctgtctctgccctgtctctgccc

SEQ ID NO: 129948 - DNA, 1322 bp, Homo sapiens
  Payload ID: 5419
  Gene Symbol: ENO3
  Gene Name: enolase 3 (beta, muscle)
  Uniprot ID: P13929
  ENST ID: ENST00000519584
  CDS Start-End: 67-1242
gacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaagccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaacc

SEQ ID NO: 129949 - DNA, 1448 bp, Homo sapiens
  Payload ID: 5419
  Gene Symbol: ENO3
  Gene Name: enolase 3 (beta, muscle)
  Uniprot ID: P13929
  ENST ID: ENST00000518175
  CDS Start-End: 73-1377
aaagggcaagggatttctggttccttaagagatcaactgtctacactcactcacacctcctgtcctgcagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactg

SEQ ID NO: 129950 - DNA, 656 bp, Homo sapiens
  Payload ID: 5419
  Gene Symbol: ENO3
  Gene Name: enolase 3 (beta, muscle)
  ENST ID: ENST00000521811
  CDS Start-End: 213-656
ggctcagggataaatgcgcagcctgagagggggtgagctgacactgtcccagctgccacctagactcggagctccatccaaacctccagcgaagacatcccagctccagcacctgccttcttggagtggggaagaatcttaaagggcaagggatttctggttccttaagagatcaactgtctacactcactcacacctcctgtcctgcagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgcca

SEQ ID NO: 129951 - DNA, 1081 bp, Homo sapiens
  Payload ID: 5419
  Gene Symbol: ENO3
  Gene Name: enolase 3 (beta, muscle)
  ENST ID: ENST00000522301
  CDS Start-End: 444-1081
gctggtatggctgcagaggagctcggggcagaccccgcactggccccagagccggcaaagtggagatctctaccgagggcagagacctacctccccgcagtgctacaagtggggcgccggaagagccccaggcgtgcagaagctcacaaaaggccacccgtcctcggtccattcatttttgttcactgttgattcagccccattcattgatgggctggggccgtgcgctgagcgcccacagtcgatggggaaaggggctctgaccgacagtccccacgccgggcgacaagtgctgtcccagcgttatcagtcgggcgccttgccagccgaaagggcctgtctaaattcgtttcctgtcccctaactcatcccggcgctggctggcctggagagggtaggatggggcggcgccgagaatggccgttatgaggaccctaagagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggctt

SEQ ID NO: 129952 - DNA, 343 bp, Homo sapiens
  Payload ID: 5419
  Gene Symbol: ENO3
  Gene Name: enolase 3 (beta, muscle)
  ENST ID: ENST00000519266
  CDS Start-End: 259-343
cgggcaactgagggacccactcacgtgcagccgccattcgcgccgcttccagggcaagcacccagtcagggcctctcgctgcgcgccctagaccgcgcccgcccccacccaagtccctccctcagggtccaaaccggagcagtgccccggaccgcgcaggcctcgcagtaccgtgatgttgacgaacgttttcccggggacggcggcccagacggagggcgagtccttgtagcccacgatggccgcgtcctgacagccatggccatgcagaaaatctttgcccgggaaatcttggactccaggggcaaccccacggtggaggtggacctgcacacggccaagg

SEQ ID NO: 129953 - DNA, 714 bp, Homo sapiens
  Payload ID: 5419
  Gene Symbol: ENO3
  Gene Name: enolase 3 (beta, muscle)
  ENST ID: ENST00000520221
  CDS Start-End: 125-714
cctcgcagtaccgtgatgttgacgaacgttttcccggggacggcggcccagacggagggcgagtccttgtagcccacgatggccgcgtcctgacaggtcccgtccgccatgaggttgtcgatccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaa

SEQ ID NO: 129954 - DNA, 2865 bp, Homo sapiens
  Payload ID: 5420
  Gene Symbol: ENO4
  Gene Name: enolase family member 4
  ENST ID: ENST00000341276
  CDS Start-End: 56-1933
agggacgctcgtgggaccccaggctaaaccccgctgtagccttaaatctcctaccatggaggaagaaggcggcggccgcagctgtgggaccactagggagctgcagaagctgaagcagcaggcgatggagtactaccgggagaacgacgttccgcgcaggctggaagagctgctcaactccaccttctacctccagcctgccgacgtctacgggcacctggcaaactgcttttctaaacttgcaaagcctcccaccatatgcaaaatagtggggaaagacgtactagatggactggggcttccaaccctgcaagtggacatattctgcaccattcaaaactttcccaagaacgtatgttctgtggtgatctcgactcattttgaagtccatgagaatgctctgcccgagctggccaaggcggaggaggcagagagggccagcgcggtgagcaccgccgtgcagtgggtcaacagcaccatcacgcacgagctccaggggatggcaccctctgaccaggcagaggtggatcacctactcaggatattcttcgcaagtaaagtacaagaagataaggggagaaaagaattggaaaagagcctggaatactcaacagtgcctacacctctacctccagtaccaccaccaccaccccctccacctcctaccaaaaaaaaggggcaaaagccagggaggaaggatactattacagagaaacctattgcgcctgcagagcctgttgagcctgtactcagtggcagtatggccataggggccgtgtcactagctgttgccaaagcctgtgccatgctgcttaataaacctctgtacttaaatatcgctctactgaagcacaatcaggaacagccaacaacgctatctatgcctttgctgatggtatcgctggtcagctgtgggaagtcatcatctgggaagctaaatttaatgaaagaagtgatttgtataccccatcctgaattaacaaccaaacaaggtgtcgagatgcttatggaaatgcagaaacatatcaacaaaataattgaaatgccctctcctccaaaagcagagacaaaaaaagggcacgatggaagcaaaagaggtcaacagcagatcactggcaagatgtctcatcttggctgtttaaccattaactgtgactccatagaacagccactgcttctaatacaggaaatctgtgccaacctggggctagaactgggaacaaatctgcatctagctatcaactgtgctggacatgagctgatggactacaataaaggaaagtatgaagtgatcatgggcacatacaaaaatgcagcggagatggttgacctgtatgtggatctgatcaacaagtacccttcaattattgccttaattgatcctttcaggaaggaggactctgaacagtgggacagcatctatcacgcacttggttccaggtgttacataattgcaggaactgcttccaaaagcatttctaaacttctagagcaaggaaacatcagcatccccaaatccaatgggctgatcataaaacacacaaaccaaactacaatgtctgacttggtggaaataaccaatctgattgacagtaagaagcacatcactgtctttggaagtacagaaggagaatcatctgatgacagccttgtcgatttggctgttgggcttggtgtccggttcatcaagttggggggtctttcccgtggtgaacgagtgactaaatacaaccgccttctcactatagaggaagaacttgtccagaatggaacactgggtttcaaagaagaacacacttttttttactttaatgaggaagctgaaaaggctgcggaggcacttgaggctgctgcggctagggagccgctggtgcccaccttccccacacaaggtgtagaggaatcagccgaaacaggagcatcctctggatagggctgtacacaccccaggttccagccacaccatcagtattagtagaccgggaggtctgaagtacggcgccgtgtctccacatggagtttcctcttcaacttcaccaactcttgtggtttttattcttctaattccactgtttggtaaattacatatatgatgtttttgcctgaaattctgtgaacttcgttttgcagccaccacacttccatgtggattttgtttgtctattagctctcctgtccatttttcagggacacgctccagtaaaagaggccaatatttttgttgccaactccacactcagtcaaacaccccatcctttaccaatcagaatatctctgagaacaaaaacctaatgaccctagaagctctctgtgctgggaacagatgtccatcttctgtgtttattctacatgtctgtgctgaaaagcactgacacatttttgtaaccaacctcacgtagaagtgtgagagcatcaccattttttgtaagagccaatttcatctcactttcctacccttgattccttttttcctaattccctctcctttttaaattttagtttttcttgtattatttttatctttgcgagtcttcttagatcctttttggagtaagaatgagtataaatgaataagcacatcagtaaatgaattaatattctcaaggttattaaatgcccagttattcataccacagcatttaaaaagcaatccgcaagtgataaaaaaaaaaaaaaaaaatgatgtgacatatccattgcctgaattgctcttttgtaagccagtgttgggattatagcagaggagtagcagaaataaatatattcagacacaaacatatagatataataatatccaaccactttatatgatttagggtctcgttaaaatggttaccatttgcttctcctaaaaattatataaat

SEQ ID NO: 129955 - DNA, 1484 bp, Homo sapiens
  Payload ID: 5420
  Gene Symbol: ENO4
  Gene Name: enolase family member 4
  ENST ID: ENST00000369207
  CDS Start-End: 177-1268
aattggaaaagagcctggaatactcaacagtgcctacacctctacctccagtaccaccaccaccaccccctccacctcctaccaaaaaaaaggggcaaaagccagggaggaaggatactattacagagaaacctattgcgcctgcagagcctgttgagcctgtactcagtggcagtatggccataggggccgtgtcactagctgttgccaaagcctgtgccatgctgcttaataaacctctgtacttaaatatcgctctactgaagcacaatcaggaacagccaacaacgctatctatgcctttgctgatggtatcgctggtcagctgtgggaagtcatcatctgggaagctaaatttaatgaaagaagtgatttgtataccccatcctgaattaacaaccaaacaaggtgtcgagatgcttatggaaatgcagaaacatatcaacaaaataattgaaatgccctctcctccaaaagcagagacaaaaaaagggcacgatggaagcaaaagaggtcaacagcagatcactggcaagatgtctcatcttggctgtttaaccattaactgtgactccatagaacagccactgcttctaatacaggaaatctgtgccaacctggggctagaactgggaacaaatctgcatctagctatcaactgtgctggacatgagctgatggactacaataaaggaaagtatgaagtgatcatgggcacatacaaaaatgcagcggagatggttgacctgtatgtggatctgatcaacaagtacccttcaattattgccttaattgatcctttcaggaaggaggactctgaacagtgggacagcatctatcacgcacttggttccaggtgttacataattgcaggaactgcttccaaaagcatttctaaacttctagagcaaggaaacatcagcatccccaaatccaatgggctgatcataaaacacacaaaccaaactacaatgtctgacttggtggaaataaccaatctgattgacagtaagaagcacatcactgtctttggaagtacagaaggagaatcatctgatgacagccttgtcgatttggctgttgggcttggtgtccggttcatcaagttggggggtctttcccgtggtgaacgagtgactaaatacaaccgccttctcactatagaggaagaacttgtccagaatggaacactggccacttcatcttcaagctgtgatgccaggattggagggcaagaacaggaaacaatgactttggtgaaagtgtaaccactcttttagaacaaaaacagcacagtgttatttgaaaaattattaacatatgtgatggagcagtctgtaagcacgatcaaataaactggccaaagatgaggctaattgtaaatgggaataaaacacaccacaaacaattcacaaaaaacagattttaaaatactctcctttcatttccccattagctaaacaataaactgaaatctattctta

SEQ ID NO: 129956 - DNA, 1840 bp, Homo sapiens
  Payload ID: 5420
  Gene Symbol: ENO4
  Gene Name: enolase family member 4
  Uniprot ID: A6NNW6
  ENST ID: ENST00000409522
  CDS Start-End: 56-982
agggacgctcgtgggaccccaggctaaaccccgctgtagccttaaatctcctaccatggaggaagaaggcggcggccgcagctgtgggaccactagggagctgcagaagctgaagcagcaggcgatggagtactaccgggagaacgacgttccgcgcaggctggaagagctgctcaactccaccttctacctccagcctgccgacgtctacgggcacctgccctctcctccaaaagcagagacaaaaaaagggcacgatggaagcaaaagaggtcaacagcagatcactggcaagatgtctcatcttggctgtttaaccattaactgtgactccatagaacagccactgcttctaatacaggaaatctgtgccaacctggggctagaactgggaacaaatctgcatctagctatcaactgtgctggacatgagctgatggactacgactctgaacagtgggacagcatctatcacgcacttggttccaggtgttacataattgcaggaactgcttccaaaagcatttctaaacttctagagcaaggaaacatcagcatccccaaatccaatgggctgatcataaaacacacaaaccaaactacaatgtctgacttggtggaaataaccaatctgattgacagtaagaagcacatcactgtctttggaagtacagaaggagaatcatctgatgacagccttgtcgatttggctgttgggcttggtgtccggttcatcaagttggggggtctttcccgtggtgaacgagtgactaaatacaaccgccttctcactatagaggaagaacttgtccagaatggaacactgggtttcaaagaagaacacacttttttttactttaatgaggaagctgaaaaggctgcggaggcacttgaggctgctgcggctagggagccgctggtgcccaccttccccacacaaggtgtagaggaatcagccgaaacaggagcatcctctggatagggctgtacacaccccaggttccagccacaccatcagtattagtagaccgggaggtctgaagtacggcgccgtgtctccacatggagtttcctcttcaacttcaccaactcttgtggtttttattcttctaattccactgtttggtaaattacatatatgatgtttttgcctgaaattctgtgaacttcgttttgcagccaccacacttccatgtggattttgtttgtctattagctctcctgtccatttttcagggacacgctccagtaaaagaggccaatatttttgttgccaactccacactcagtcaaacaccccatcctttaccaatcagaatatctctgagaacaaaaacctaatgaccctagaagctctctgtgctgggaacagatgtccatcttctgtgtttattctacatgtctgtgctgaaaagcactgacacatttttgtaaccaacctcacgtagaagtgtgagagcatcaccattttttgtaagagccaatttcatctcactttcctacccttgattccttttttcctaattccctctcctttttaaattttagtttttcttgtattatttttatctttgcgagtcttcttagatcctttttggagtaagaatgagtataaatgaataagcacatcagtaaatgaattaatattctcaaggttattaaatgcccagttattcataccacagcatttaaaaagcaatccgcaagtgataaaaaaaaaaaaaaaaaatgatgtgacatatccattgcctgaattgctcttttgtaagccagtgttgggattatagcagaggagtagcagaaataaatatattcagacacaaacatatagatataataa

SEQ ID NO: 129957 - DNA, 415 bp, Homo sapiens
  Payload ID: 5420
  Gene Symbol: ENO4
  Gene Name: enolase family member 4
  ENST ID: ENST00000512864
  CDS Start-End: 1-415
gcggccgcagctgtgggaccactagggagctgcagaagctgaagcagcaggcgatggagtactaccgggagaacgacgttccgcgcaggctggaagagctgctcaactccaccttctacctccagcctgccgacgtctacgggcacctggcaaactgcttttctaaacttgcaaagcctcccaccatatgcaaaatagtggggaaagacgtactagatggactggggcttccaaccctgcaagtggacatattctgcaccattcaaaactttcccaagaacgtatgttctgtggtgatctcgactcattttgaagtccatgagaatgctctgcccgagctggccaaggcggaggaggcagagagggccagcgcggtgagcaccgccgtgcagtgggtcaacagcaccatcacgca

SEQ ID NO: 129958 - DNA, 2874 bp, Homo sapiens
  Payload ID: 5420
  Gene Symbol: ENO4
  Gene Name: enolase family member 4
  ENST ID: ENST00000622726
  CDS Start-End: 56-1942
agggacgctcgtgggaccccaggctaaaccccgctgtagccttaaatctcctaccatggaggaagaaggcggcggccgcagctgtgggaccactagggagctgcagaagctgaagcagcaggcgatggagtactaccgggagaacgacgttccgcgcaggctggaagagctgctcaactccaccttctacctccagcctgccgacgtctacgggcacctgaaagcaaactgcttttctaaacttgcaaagcctcccaccatatgcaaaatagtggggaaagacgtactagatggactggggcttccaaccctgcaagtggacatattctgcaccattcaaaactttcccaagaacgtatgttctgtggtgatctcgactcattttgaagtccatgagaatgctctgcccgagctggccaaggcggaggaggcagagagggccagcgcggtgagcaccgccgtgcagtgggtcaacagcaccatcacgcacgagctccaggggatggcaccctctgaccaggcagaggtggatcacctactcaggatattcttcgcaagtaaagtacaagaagataaggggagaaaagaattggaaaagagcctggaatactcaacagtgcctacacctctacctccagtaccaccaccaccaccccctccacctcctaccaaaaaaaaggggcaaaagccagggaggaaggatactattacagagaaacctattgcgcctgcagagcctgttgagcctgtactcagtggcagtatggccataggggccgtgtcactagctgttgccaaagcctgtgccatgctgcttaataaacctctgtacttaaatatcgctctactgaagcacaatcaggaacagccaacaacgctatctatgcctttgctgatggtatcgctggtcagctgtgggaagtcatcatctgggaagctaaatttaatgaaagaagtgatttgtataccccatcctgaattaacaaccaaacaaggtgtcgagatgcttatggaaatgcagaaacatatcaacaaaataattgaaatggcgcctccctctcctccaaaagcagagacaaaaaaagggcacgatggaagcaaaagaggtcaacagcagatcactggcaagatgtctcatcttggctgtttaaccattaactgtgactccatagaacagccactgcttctaatacaggaaatctgtgccaacctggggctagaactgggaacaaatctgcatctagctatcaactgtgctggacatgagctgatggactacaataaaggaaagtatgaagtgatcatgggcacatacaaaaatgcagcggagatggttgacctgtatgtggatctgatcaacaagtacccttcaattattgccttaattgatcctttcaggaaggaggactctgaacagtgggacagcatctatcacgcacttggttccaggtgttacataattgcaggaactgcttccaaaagcatttctaaacttctagagcaaggaaacatcagcatccccaaatccaatgggctgatcataaaacacacaaaccaaactacaatgtctgacttggtggaaataaccaatctgattgacagtaagaagcacatcactgtctttggaagtacagaaggagaatcatctgatgacagccttgtcgatttggctgttgggcttggtgtccggttcatcaagttggggggtctttcccgtggtgaacgagtgactaaatacaaccgccttctcactatagaggaagaacttgtccagaatggaacactgggtttcaaagaagaacacacttttttttactttaatgaggaagctgaaaaggctgcggaggcacttgaggctgctgcggctagggagccgctggtgcccaccttccccacacaaggtgtagaggaatcagccgaaacaggagcatcctctggatagggctgtacacaccccaggttccagccacaccatcagtattagtagaccgggaggtctgaagtacggcgccgtgtctccacatggagtttcctcttcaacttcaccaactcttgtggtttttattcttctaattccactgtttggtaaattacatatatgatgtttttgcctgaaattctgtgaacttcgttttgcagccaccacacttccatgtggattttgtttgtctattagctctcctgtccatttttcagggacacgctccagtaaaagaggccaatatttttgttgccaactccacactcagtcaaacaccccatcctttaccaatcagaatatctctgagaacaaaaacctaatgaccctagaagctctctgtgctgggaacagatgtccatcttctgtgtttattctacatgtctgtgctgaaaagcactgacacatttttgtaaccaacctcacgtagaagtgtgagagcatcaccattttttgtaagagccaatttcatctcactttcctacccttgattccttttttcctaattccctctcctttttaaattttagtttttcttgtattatttttatctttgcgagtcttcttagatcctttttggagtaagaatgagtataaatgaataagcacatcagtaaatgaattaatattctcaaggttattaaatgcccagttattcataccacagcatttaaaaagcaatccgcaagtgataaaaaaaaaaaaaaaaaatgatgtgacatatccattgcctgaattgctcttttgtaagccagtgttgggattatagcagaggagtagcagaaataaatatattcagacacaaacatatagatataataatatccaaccactttatatgatttagggtctcgttaaaatggttaccatttgcttctcctaaaaattatataaat

SEQ ID NO: 129959 - DNA, 1867 bp, Homo sapiens
  Payload ID: 5421
  Gene Symbol: ENOSF1
  Gene Name: enolase superfamily member 1
  Uniprot ID: Q7L5Y1
  ENST ID: ENST00000251101
  CDS Start-End: 90-1421
cgctcccgccctcccgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaa

SEQ ID NO: 129960 - DNA, 1658 bp, Homo sapiens
  Payload ID: 5421
  Gene Symbol: ENOSF1
  Gene Name: enolase superfamily member 1
  Uniprot ID: Q7L5Y1
  ENST ID: ENST00000340116
  CDS Start-End: 39-1391
gcttccccacgtcgcttgggggccacggcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagg

SEQ ID NO: 129961 - DNA, 4188 bp, Homo sapiens
  Payload ID: 5421
  Gene Symbol: ENOSF1
  Gene Name: enolase superfamily member 1
  Uniprot ID: Q7L5Y1
  ENST ID: ENST00000383578
  CDS Start-End: 206-1291
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaaagcaaaaagaacttttacctcggcatccagcccaacccctaaagactgacaatatccttcgagctcctttgaaagcaccctaaacagccatttccattttaatagttggatgcggattgtacccttcaatctgaaagtcttcagctttgaagtcatcaattttctcaacttttcgaagaatcctgagctttgggaaaggtctgggttctcgctgaagctaaaaacaaaataaggccattattttgccataattgtacgacctgttgtaattgctcctcatgtccgtgaaacaagtacacaggatgtgatcaacaaagttctattttacaggagtatgatcctgtcgataccttgccgtaggttatgtaacatgattggagcgcaaccagctgttctcttgcacagatcgagagtgaggggtattttgtgacattacacagcatcaggagcctggtgcctcatcaggtgtaagttcttataaccactcttggcaaatttattaaagacaggaacacagtcaatctgtaactcatagtagctctacgtttacttgaattccacaatccctaacccatctgtccctggcagaaagaaggaaagatgacatgcatggacagtgaacagaaagggatgaaagccaggattcctgggatgaacagacagtggcaattaggatgtgaagacaggtcacaacctattactatgtctaaaaacgaccagagcagagagccagagagaataagcctgaagtcacctccactcaaaagcagccaaactccctcaaaggagtaacttttaaaacctggatctaacctggaaggggctaaaaagtgtctggttctgagtttttttccttaaggctcatgaagcagatgaacttacatttttattgccatttcatatcaattgttggctgctataacttagggatttcaacagacttttgaagtttggacctaaatattgtacttaatgtaaaattaacaaaaaatatttatggccagggtggtggcttatgcctgtaattccagaattttcggaggctgaggcaggtggatcacttgaagtcaggagtttgagactagcctggccaacatgatgaaaccccatctctactaataatacaaaaattagctgggtgtggtggcatgtgcctgtaatcccagctacctgggaggctgaggcagaagaattgcttgaacccgggaggtggaggttgcagtgagctgagatcgcaccacggcacactccagcctggccgacagagaaagactccatctcaaaaaaaaaagaaaaggaaaaacatttgcacttcaattctccttcaagttaaaatgagttaaaatgcccccttttggacaatcccctggcttgaatgtggctcttccctctctggtactggtgcttagtacctcacagcacctgacatgttaagtgcccatggttgctgaggcagatgcctgccttgtcctgcccacctgcccaccacttctccctaaactgaagccccacatttggagcagtcatctttatcttggacacagcattgagcagatgcctgttccacagtcaaccttttatcaagagaaggtaccaaacccaaaagtataacatctaattcttacctgaattttcagtggctcgatgtgattcaggtaaatatgtgcatctcccaaagtgtgtataaagtcacctggctataaacccgggggagaaagcagaacagtatgttagtttcaattctttaaaacatcatttaaaaacattagaatatgcagacaccgcaaggctttttttaaaaaaataatttagtgtagcttttccatttttttgtagcaacagcatcttgttatgttgcccaggctggtattgaactccagacctcaagcaattgctcctgtctcagtctcccaaagtgctgggattacaggcatgagccaccatacccaacctcagcatagcttttgagaaaatccatagaagctgtatcacaaacaacctgtatagatctgttagtgcgtataccacagggccagaaaaccttccagaagaggaaggtttcaaagtaaaagctggttcatttcttacttacacatatcaaatttaaaagctaatcagagactaaactctgcaatttgttttcccatattaaagaactgaagagctcagtgtggtaggctggcaagtcacccttcccgagacagcccaccttcaggcccgtgatgtgcgcaatcatgtacgtgagcagggcgtagctggcgatgttgaaaggcacaccgaggcccatgtctcccgatctctggtacagctggcaggacagctcactgttcaccacatagaactggcagagggcatggcatggaggcagcgccatcagaggaagatctgaggaaccagcagaggaagataaggagggatggtggtttgaaagaccacagctaaaggcaaagtaaaacaggagagaaacagaagccaactcatatggtggagaccaggagagagagccactgggctgcagtgatgtccataacagcctctgcagcgatggcacggagctgagggagactatccatcggtgcaaggtttctgcaggtgtccatttacggctgaagcaatgctcttccatcagagctgaagggatctgggctacctcgtggcaccagattacaaatacagcaggaataattctgtttgccacaggaaactggtgcttctggtacaccctcctatattaaaagtctctattacatggc

SEQ ID NO: 129962 - DNA, 1296 bp, Homo sapiens
  Payload ID: 5421
  Gene Symbol: ENOSF1
  Gene Name: enolase superfamily member 1
  ENST ID: ENST00000585128
  CDS Start-End: 1-290
gccacggcgcggacgccatgcacacggaccctgactactcggctgcctatgtcgtcatagaaactgatgcagaagatggaatcaaggggtgtggaattaccttcactctgggaaaaggcactgaagttgattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaa

SEQ ID NO: 129963 - DNA, 1397 bp, Homo sapiens
  Payload ID: 5421
  Gene Symbol: ENOSF1
  Gene Name: enolase superfamily member 1
  ENST ID: ENST00000580982
  CDS Start-End: 29-1132
ggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgattggtccagaaaagggcgtggtgcacctggcgacagcggccgtcctaaacgcggtgtgggacttgtgggccaagcaggagggaaagcctgtctggaagttacttgtggacatgagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaa

SEQ ID NO: 129964 - DNA, 1230 bp, Homo sapiens
  Payload ID: 5421
  Gene Symbol: ENOSF1
  Gene Name: enolase superfamily member 1
  ENST ID: ENST00000584453
  CDS Start-End: 38-577
gaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatgaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatct

SEQ ID NO: 129965 - DNA, 1745 bp, Homo sapiens
  Payload ID: 5421
  Gene Symbol: ENOSF1
  Gene Name: enolase superfamily member 1
  ENST ID: ENST00000581475
  CDS Start-End: 21-635
ggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatgggccggatcaggagaacagctggactctccaggggaaacagcttagctacaggcacttccaattccgaagggccctggaaagtgcaaaatgttgacggcgctgtgttttcacagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaaca

SEQ ID NO: 129966 - DNA, 436 bp, Homo sapiens
  Payload ID: 5421
  Gene Symbol: ENOSF1
  Gene Name: enolase superfamily member 1
  ENST ID: ENST00000583771
  CDS Start-End: 143-436
gcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactca

SEQ ID NO: 129967 - DNA, 2025 bp, Homo sapiens
  Payload ID: 5422
  Gene Symbol: ENOPH1
  Gene Name: enolase-phosphatase 1
  Uniprot ID: Q9UHY7
  ENST ID: ENST00000273920
  CDS Start-End: 269-1054
aagggccgccccttttcctgcccacgtggtctcgggctcctgccccgtcctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggtaccacaaccccgattgctttcgtgaaggacattttatttccttacatcgaagaaaatgttaaagagtatctgcagacacattgggaagaagaggagtgccagcaggatgtcagtcttttgaggaaacaggctgaagaggacgcccacctggatggggctgttcctatccctgcagcatctgggaatggagtggatgatctgcaacagatgatccaggccgtggtagataatgtgtgctggcagatgtccctggatcgaaagaccactgcactcaaacagctgcagggccacatgtggagggcggcattcacagctgggcgcatgaaagcagagttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttcactca

SEQ ID NO: 129968 - DNA, 1874 bp, Homo sapiens
  Payload ID: 5422
  Gene Symbol: ENOPH1
  Gene Name: enolase-phosphatase 1
  ENST ID: ENST00000509635
  CDS Start-End: 418-939
tccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggacattttatttccttacatcgaagaaaatgttaaagagtatctgcagacacattgggaagaagaggagtgccagcaggatgtcagtcttttgaggaaacaggctgaagaggacgcccacctggatggggctgttcctatccctgcagcatctgggaatggagtggatgatctgcaacagatgatccaggccgtggtagataatgtgtgctggcagatgtccctggatcgaaagaccactgcactcaaacagctgcagggccacatgtggagggcggcattcacagctgggcgcatgaaagcagagttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttc

SEQ ID NO: 129969 - DNA, 1689 bp, Homo sapiens
  Payload ID: 5422
  Gene Symbol: ENOPH1
  Gene Name: enolase-phosphatase 1
  Uniprot ID: Q9UHY7
  ENST ID: ENST00000505846
  CDS Start-End: 375-722
tgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggacattttatttccttacatcgaagaaaatgttaaagagtatctgcagacacattgggaagaagaggagtgccagcaggatgtcagtcttttgaggaaacaggttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttca

SEQ ID NO: 129970 - DNA, 979 bp, Homo sapiens
  Payload ID: 5422
  Gene Symbol: ENOPH1
  Gene Name: enolase-phosphatase 1
  ENST ID: ENST00000618400
  CDS Start-End: 221-844
cctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggtaccacaaccccgattgctttcgtgaaggacattttatttccttacatcgaagaaaatgttaaagagtatctgcagacacattgggaagaagaggagtgccagcaggatgtcagtcttttgaggaaacaggctgaagaggacgcccacctggatggggctgttcctatccctgcagcatctgggaatggagtggatgatctgcaacagatgatccaggccgtggtagataatgtgtgctggcagatgtccctggatcgaaagaccactgcactcaaacagctgcagggccacatgtggagggcggcattcacagctgggcgcatgaaagcagagttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtttaccgaaagattgcagacagcattgggtgctcaaccaaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactat

SEQ ID NO: 129971 - DNA, 1542 bp, Homo sapiens
  Payload ID: 5422
  Gene Symbol: ENOPH1
  Gene Name: enolase-phosphatase 1
  ENST ID: ENST00000610545
  CDS Start-End: 52-501
gctgttcctatccctgcagcatctgggaatggagtggatgatctgcaacagatgatccaggccgtggtagataatgtgtgctggcagatgtccctggatcgaaagaccactgcactcaaacagctgcagggccacatgtggagggcggcattcacagctgggcgcatgaaagcagagttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttcactc

SEQ ID NO: 129972 - DNA, 1411 bp, Homo sapiens
  Payload ID: 5423
  Gene Symbol: ECH1
  Gene Name: enoyl CoA hydratase 1, peroxisomal
  Uniprot ID: Q13011
  ENST ID: ENST00000221418
  CDS Start-End: 234-1220
gctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggaggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 129973 - DNA, 440 bp, Homo sapiens
  Payload ID: 5423
  Gene Symbol: ECH1
  Gene Name: enoyl CoA hydratase 1, peroxisomal
  ENST ID: ENST00000601094
  CDS Start-End: 332-440
gacggggagggctatccggggtcacgaagggcccgagtcccctaaattcaggggtgcgtgtgctcccttttgaaggactccctaattcgataggcctgtgtcttgcagtctggggtcatcaaaggctgttcctttctccccaggactgacaggctccaactacccgggactcagtattagccttcgcctcactggctcctctgcacaagaggaggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcag

SEQ ID NO: 129974 - DNA, 209 bp, Homo sapiens
  Payload ID: 5423
  Gene Symbol: ECH1
  Gene Name: enoyl CoA hydratase 1, peroxisomal
  ENST ID: ENST00000602115
  CDS Start-End: 1-209
cgcagactccgcgacctactgacccggcgtgagtcacctcttgccttatgggggtgcgtcgcgctgtcgtgctgttatagcagatgtaggacggggagggctatccggggtcacgaagggcccgagtcccctaaattcaggggactgacaggctccaactacccgggactcagtattagccttcgcctcactggctcctctgcacaaga

SEQ ID NO: 129975 - DNA, 560 bp, Homo sapiens
  Payload ID: 5423
  Gene Symbol: ECH1
  Gene Name: enoyl CoA hydratase 1, peroxisomal
  ENST ID: ENST00000595470
  CDS Start-End: 18-560
agacgaaggcggcggcgatggcggcggggatagtggcttctcgcagactccgcgacctactgacccggcgactgacaggctccaactacccgggactcagtattagccttcgcctcactggctcctctgcacaagaggaggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgagtctgcggctatcctc

SEQ ID NO: 129976 - DNA, 677 bp, Homo sapiens
  Payload ID: 5423
  Gene Symbol: ECH1
  Gene Name: enoyl CoA hydratase 1, peroxisomal
  ENST ID: ENST00000594164
  CDS Start-End: 11-124
ggcggcggcgatggcggcggggatagtggcttctcgcagactccgcgacctactgacccggcgtgagtcacctcttgccttatgggggactgacaggctccaactacccgggactcagtattagccttcgcctcactggctcctctgcacaagaggaggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaag

SEQ ID NO: 129977 - DNA, 169 bp, Homo sapiens
  Payload ID: 5423
  Gene Symbol: ECH1
  Gene Name: enoyl CoA hydratase 1, peroxisomal
  ENST ID: ENST00000597205
  CDS Start-End: 4-169
gcgatggcggcggggatagtggcttctcgcagactccgcgacctactgacccggcgtgagtcacctcttgccttatggggagagatggtagagtgcttcaacaagatttcgagagacgctgactgtcgggcggtggtgatctctggtgcaggaaaaatgttcactgcag

SEQ ID NO: 129978 - DNA, 799 bp, Homo sapiens
  Payload ID: 5423
  Gene Symbol: ECH1
  Gene Name: enoyl CoA hydratase 1, peroxisomal
  ENST ID: ENST00000601778
  CDS Start-End: 1-799
gatagtggcttctcgcagactccgcgacctactgacccggcgactgacaggctccaactacccgggactcagtattagccttcgcctcactggctcctctgcacaagaggaggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtg

SEQ ID NO: 129979 - DNA, 308 bp, Homo sapiens
  Payload ID: 5423
  Gene Symbol: ECH1
  Gene Name: enoyl CoA hydratase 1, peroxisomal
  ENST ID: ENST00000595567
  CDS Start-End: 257-308
ttatagcagatgtaggacggggagggctatccggggtcacgaagggcccgagtcccctaaattcaggggactgacaggctccaactacccgggactcagtattagccttcgcctcactggctcctctgcacaagaggaggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcga

SEQ ID NO: 129980 - DNA, 1126 bp, Homo sapiens
  Payload ID: 5424
  Gene Symbol: ECHDC2
  Gene Name: enoyl CoA hydratase domain containing 2
  Uniprot ID: Q86YB7
  ENST ID: ENST00000358358
  CDS Start-End: 54-839
agccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattag

SEQ ID NO: 129981 - DNA, 1606 bp, Homo sapiens
  Payload ID: 5424
  Gene Symbol: ECHDC2
  Gene Name: enoyl CoA hydratase domain containing 2
  ENST ID: ENST00000371520
  CDS Start-End: 31-228
gaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggtaaatgtgcagttccggggcggcgcatgacgcgactgggactaggccggaggcagcgggggaccggcaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattaga

SEQ ID NO: 129982 - DNA, 1509 bp, Homo sapiens
  Payload ID: 5424
  Gene Symbol: ECHDC2
  Gene Name: enoyl CoA hydratase domain containing 2
  Uniprot ID: Q86YB7
  ENST ID: ENST00000371522
  CDS Start-End: 95-973
gaaggcttcgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctgagtcttggtatcattggctctcagcccctgacctctctcagttatcaggcactcattagagatgtcagaagattttaagatacccctagtttcttcctgtgaacaacagaggtaataaataaactctgacatcggttgaacatgtgtcaggggtcagactgcagatcccagtctctgccagttacttgctgtataaccgtggacaaattgtttaaatgctctgggcctcagcttcctcac

SEQ ID NO: 129983 - DNA, 981 bp, Homo sapiens
  Payload ID: 5424
  Gene Symbol: ECHDC2
  Gene Name: enoyl CoA hydratase domain containing 2
  ENST ID: ENST00000542552
  CDS Start-End: 113-244
ataggtggagcaattggcgaaggcttcgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagctgggcactaaggttctccaccacaagctgacctttccatcctccctcctctacccatgggctcatttgaaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaaggtaggaggaaggagaatgggggcctgccaaagccaaggcagatacgtgtcattatgcatctgtgtaaacccacagagtgtacaccaccaagagcgaaccccagtgtacactagggcccccgggtggcgacagtgcatcagtgtaggttcgtcagttgcaacacgtgcctctggtgggggatggggattgcggaaggggctgtgcctgtgtagggccagggagtataggtgaactgtattgaattgtattttccactccattttgctgtgaccctaaaactgctctaagaaaatcatctatttataaacaaataaatattcttctaagaagccaaagcagaaaacgatcaagtggagtgtgttaatgtcagcaaaggtttttgctgccacgaggttgaggcaaggagagaaacgtgtcccttggttagtgatgtggctatattcatcactttaatgagaataatgtctgctgagtg

SEQ ID NO: 129984 - DNA, 1446 bp, Homo sapiens
  Payload ID: 5424
  Gene Symbol: ECHDC2
  Gene Name: enoyl CoA hydratase domain containing 2
  ENST ID: ENST00000536120
  CDS Start-End: 102-836
aattggcgaaggcttcgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctgagtcttggtatcattggctctcagcccctgacctctctcagttatcaggcactcattagagatgtcagaagattttaagatacccctagtttcttcctgtgaacaacagaggtaataaataaactctgacatcggttgaacatgtgtcaggggtcagactgcagatcccagtctctgccagttacttgctgtataaccgtggacaaattgtttaaatgctctgggcctcagcttcctcacctacaaaacaaaacttgtgaagatttagcaaaataaaaacacttcatattcaataaatatgttttaattgttaa

SEQ ID NO: 129985 - DNA, 1335 bp, Homo sapiens
  Payload ID: 5424
  Gene Symbol: ECHDC2
  Gene Name: enoyl CoA hydratase domain containing 2
  ENST ID: ENST00000544365
  CDS Start-End: 351-500
agcgttctctagcccttaggcagccgaatccctaatttgcggacttgggcatgggactgagtcaacctgtccccatctctgatcctgtgcttaggttctgtacggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcggtgaggatctgggtgtggggtggaggagggggtttgggggtccctgccgatgacagtcccgctacccccaccagcatctaaggagagtcttctttctgtttggagttctgtgataagacagatgactcacccagggggatggaggaggatgaccgagggcagttctctcagagagggagttctggctcttcagcttttgtgtcccgccccaccctcagggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctg

SEQ ID NO: 129986 - DNA, 702 bp, Homo sapiens
  Payload ID: 5424
  Gene Symbol: ECHDC2
  Gene Name: enoyl CoA hydratase domain containing 2
  ENST ID: ENST00000467988
  CDS Start-End: 46-702
cggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggtggacattgcatctgggatggccattgaagggatgtgctatgcccag

SEQ ID NO: 129987 - DNA, 1676 bp, Homo sapiens
  Payload ID: 5424
  Gene Symbol: ECHDC2
  Gene Name: enoyl CoA hydratase domain containing 2
  ENST ID: ENST00000476477
  CDS Start-End: 318-464
aatttgcggacttgggcatgggactgagtcaacctgtccccatctctgatcctgtgcttaggttctgtacggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagacaaagctgaggaccctgggagataataataaggggtctttgaaggccaaaggattgggaaacactcctctgggcacctgctggatttcagccctgggaagacctgaaatgtccatcctgatttttcgtaggaggagaaacagcctagaagggatgataagggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcaca

SEQ ID NO: 129988 - DNA, 1649 bp, Homo sapiens
  Payload ID: 5425
  Gene Symbol: ECHDC3
  Gene Name: enoyl CoA hydratase domain containing 3
  Uniprot ID: Q96DC8
  ENST ID: ENST00000379215
  CDS Start-End: 212-1123
cgtgccggggcggggcgtagtacggactgggcctggcctggggcgtccccgcgaagcctgggcctgtcaggcggttccgtccgggtctcggccaccgtcgagttccgtcgagttccgtcccggccctgctcacagcagcgccctcggagcgcccagcacctgcggccggccaggcagcgcgatcctgcggcgtctggccatcccgaatgctatggccgccgtcgccgtcttgcgggccttcggggcaagtgggcccatgtgtctccggcgcggcccctgggcccagctccccgcccgcttctgcagccgggacccggccggggcggggcggcgggagtcggagccgcggcccaccagcgcgcggcagctggacggcataaggaacatcgtcttgagcaatcccaagaagaggaacgcgttgtcacttgcaatgctgaagtctctccaaagtgacattcttcatgacgctgacagcaacgatctgaaagtcattatcatctcggctgaggggcctgtgttttcttctgggcatgacttaaaggagctgacagaggagcaaggccgtgattaccatgccgaagtatttcagacctgttccaaggtcatgatgcacatccggaaccaccccgttcccgtcattgccatggtcaatggcctggccgcggctgccggctgtcaactggttgccagctgcgacattgccgtggcgagcgacaagtcctcttttgccactcctggggtgaacgtcgggctcttctgttctacccctggggttgccttggcaagagcagtgcctagaaaggtggccttggagatgctctttactggtgagcccatttctgcccaggaggccctgctccacgggctgcttagcaaggtggtgccagaggcggagctgcaggaggagaccatgcggatcgctaggaagatcgcatcgctgagccgtccggtggtgtccctgggcaaagccaccttctacaagcagctgccccaggacctggggacggcttactacctcacctcccaggccatggtggacaacctggccctgcgggacgggcaggagggcatcacggccttcctccagaagagaaaacctgtctggtcacacgagccagtgtgagtggaggcagaggagtgaggcccacgggcagcgcccaggagcccaccttcccctctggcccagccaccactgcctctcagcttcaacaggtgacaggctgctttcgtgacttgatattggtgtcatagcatttggcctacattaaaagccacaatttcatggggaaaggacaaaatggagagtgactgaggtgctgacctcagtgcaaggctggtgaaccctgcagcgggccagctatggtgggaagcctggcatttggggtgctccttgcaacgtcttaagcaagcgaccccccgacatagcaaaaggtggcaacccatggaggcagaaagaaggacgccagcctgacccttatctgaaacgtcctaagcagagttaatcctggctgctcaggagaggcgacacatttcaaatctccacgagatattctccacacagaaaatcttcttgattctatagagacttaatcatgcctatggctttgaataatcttatgtgatttaaataaattaaatctttatagaga

SEQ ID NO: 129989 - DNA, 623 bp, Homo sapiens
  Payload ID: 5425
  Gene Symbol: ECHDC3
  Gene Name: enoyl CoA hydratase domain containing 3
  ENST ID: ENST00000422887
  CDS Start-End: 124-623
tagacaggaatcgcaggggtcctcacttgttttgactggtgtgtgaccctgtgattgtaaaatgttcttcacaggaacatcgtcttgagcaatcccaagaagaggaacgcgttgtcacttgcaatgctgaagtctctccaaagtgacattcttcatgacgctgacagcaacgatctgaaagtcattatcatctcggctgaggggcctgtgttttcttctgggcatgacttaaaggagctgacagaggagcaaggccgtgattaccatgccgaagtatttcagacctgttccaaggtcatgatgcacatccggaaccaccccgttcccgtcattgccatggtcaatggcctggccgcggctgccggctgtcaactggttgccagctgcgacattgccgtggcgagcgacaagtcctcttttgccactcctggggtgaacgtcgggctcttctgttctacccctggggttgccttggcaagagcagtgcctagaaaggtggccttggagatgctctttactggtgagcccatttctgcccaggaggccctgctccacgggctgcttagcaaggtggtgccagaggcggagctgcaggaggagaccatgcggatcgctaggaagat

SEQ ID NO: 129990 - DNA, 854 bp, Homo sapiens
  Payload ID: 5425
  Gene Symbol: ECHDC3
  Gene Name: enoyl CoA hydratase domain containing 3
  ENST ID: ENST00000420401
  CDS Start-End: 132-854
ccgggtctcggccaccgtcgagttccgtcgagttccgtcccggccctgctcacagcagcgccctcggagcgcccagcacctgcggccggccaggcagcgcgatcctgcggcgtctggccatcccgaatgctatggccgccgtcgccgtcttgcgggccttcggggcaagtgggcccatgtgtctccggcgcggcccctgggcccagctccccgcccgcttctgcagccgggacccggccggggcggggcggcgggagtcggagccgcggcccaccagcgcgcggcagctggacggcataaggtcagccccgggccgcgcgggctcctcgcgttggtgccgagtcggggtcagggcgccgccattgacccggggaggacccggggaaccggagccccgtttacgcccctggggagggaactccccgtgtcccggacccgggcctggcagcgagacgcgcaggaacatcgtcttgagcaatcccaagaagaggaacgcgttgtcacttgcaatgctgaagtctctccaaagtgacattcttcatgacgctgacagcaacgatctgaaagtcattatcatctcggctgaggggcctgtgttttcttctgggcatgacttaaaggagctgacagaggagcaaggccgtgattaccatgccgaagtatttcagacctgttccaaggtcatgatgcacatccggaaccaccccgttcccgtcattgccatggtcaatggcctggccgcggctgccggctgtcaactggttgccagctgcgacattgccgtggcgagcgacaagtcctcttttgccactcctggggtgaacgtcgggctcttctgttctacccctggggtt

SEQ ID NO: 129991 - DNA, 1617 bp, Homo sapiens
  Payload ID: 5426
  Gene Symbol: ECHS1
  Gene Name: enoyl CoA hydratase, short chain, 1, mitochondrial
  Uniprot ID: P30084
  ENST ID: ENST00000368547
  CDS Start-End: 357-1229
cggcgcagagcccggcaggcgccgccgttgcctccgcctccgcgcggtctccccggggccagctgggaccccgagggctggggcgggggcgggggcgcgggcgactgcggcggggcctggagggcgctggtcccagcccagggcggggtcccggggacgcccctcggccttagatccgcgagcggcagctcgggcctgggggcggggcctggcggagagcgacccgctcactctgcccgggctgatctcgcgagggccgcctggtctcgcggcgctggcctgtgggcggagcgagccctgaaaggctataggcgagggggcggctccgcggggccgggcgaggagtccagagagccatggccgccctgcgtgtcctgctgtcctgcgtccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagaccttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcactggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgcgggtccttgtgtccctgccgctgaagaatggggctgctctgagggaaacgctgtctgctgccttcatacagatgctgattaaagtgatagcgattcagattacacca

SEQ ID NO: 129992 - DNA, 1541 bp, Homo sapiens
  Payload ID: 5427
  Gene Symbol: ECI1
  Gene Name: enoyl-CoA delta isomerase 1
  Uniprot ID: P42126
  ENST ID: ENST00000301729
  CDS Start-End: 49-957
aggaggcgagctcagcccgcgacctttatcccgcgcgttgcggtcaagatggcgctggtggcttctgtgcgagtcccggcgcgcgttctgctccgcgcgggggcccggctcccgggcgcggccctcgggcggacggagcgggcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaagtactgccagcgtttcattttgctgatgttacgtagaagttcctgttcctcatagcccagtggcccaaggcccagccacacacaaacacacatgggtgcctgtgcccgtcaggcaaggggagttggagggcagccttttgacttgggattgtgactggcaggggatgccattctggacctggtgaggttgccacggagtgtctctgttcccaaggcagaatcgtaagtcaagtccctggtcatccattctggcctttggactgcctgctcttaggtgtaaggccaggtggtcttggcccccatgacccacacagaactccccagggaaaagccctttggtcactgcccttactcatcaggatgaagagcgcacagtgaatcagagcaactgggggatcctgagccagcgggagtgggactctggaggcagctgtgctgccagggatccaaatgtcccttaagaaggattttgcaagaaccaaactcatccaaacccttga

SEQ ID NO: 129993 - DNA, 948 bp, Homo sapiens
  Payload ID: 5427
  Gene Symbol: ECI1
  Gene Name: enoyl-CoA delta isomerase 1
  Uniprot ID: P42126
  ENST ID: ENST00000562238
  CDS Start-End: 7-864
gtcaagatggcgctggtggcttctgtgcgagtcccggcgcgcgttctgctccgcgcgggggcccggctcccgggcgcggccctcgggcggacggagcgggcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaa

SEQ ID NO: 129994 - DNA, 961 bp, Homo sapiens
  Payload ID: 5427
  Gene Symbol: ECI1
  Gene Name: enoyl-CoA delta isomerase 1
  ENST ID: ENST00000566379
  CDS Start-End: 288-961
ctttatcccgcgcgttgcggtcaagatggcgctggtggcttctgtgcgagtcccggcgcgcgttctgctccgcgcgggtgcgaaacccggggtgggcagggatcgggccggggccggggccaggaccgggaactaacgggctcccccacgctgccttcgcaggggcccggctcccgggcgcggccctcgggcggacggagcgggcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaaga

SEQ ID NO: 129995 - DNA, 1512 bp, Homo sapiens
  Payload ID: 5427
  Gene Symbol: ECI1
  Gene Name: enoyl-CoA delta isomerase 1
  ENST ID: ENST00000570258
  CDS Start-End: 742-1473
aacacagctgggaccttactgcccagtgctcccagtggtctgaccaaaaccccacaccagacagtacaaaggcccactcccgagctgccgcttacggcccagcgggaacagactgtattcttatctttcggcatttctctgcaaataaaaaggtgccactgcggtccggcctttgtgcacttgcccttgtgctgagcaaggcgggtggcctgttcttaccgctgggttctgctgcccccacccccatttcggtgactaaacctgcagctctgatcctgttcccaaaggggcaggaggccgggctcaccccaggcagcccctggcctccctgacggccccctcgggaggggttccgtgctttgatcgcctttccagcgccgatactgcagtagctgggcccggccgagagctcgcggtcacgaacaccggcagcctcttgcctacagtgtcccgcgctgtagaagagcctgccctggcgctgagctggtcgtggctgcttcagcagtgggcctgcgcctccttgtaggccagccctggcccagatccaggtgcctgccccggaagcgcgcggctgcccggggtgaagccggagggcggcgagcggctgtttcggccggggcccggctcccgggcgcggccctcgggcggacggagcgggcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccct

SEQ ID NO: 129996 - DNA, 1380 bp, Homo sapiens
  Payload ID: 5428
  Gene Symbol: ECI2
  Gene Name: enoyl-CoA delta isomerase 2
  ENST ID: ENST00000361538
  CDS Start-End: 118-1212
acccccgagcccccgcagccctagagccgcccaagggatggcgatggcgtacttggcttggagactggcgcggcgttcgtgtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaa

SEQ ID NO: 129997 - DNA, 1407 bp, Homo sapiens
  Payload ID: 5428
  Gene Symbol: ECI2
  Gene Name: enoyl-CoA delta isomerase 2
  Uniprot ID: O75521
  ENST ID: ENST00000380118
  CDS Start-End: 38-1222
acccccgagcccccgcagccctagagccgcccaagggatggcgatggcgtacttggcttggagactggcgcggcgttcgtgtccgagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaagcttaagaattcacaca

SEQ ID NO: 129998 - DNA, 1469 bp, Homo sapiens
  Payload ID: 5428
  Gene Symbol: ECI2
  Gene Name: enoyl-CoA delta isomerase 2
  ENST ID: ENST00000380120
  CDS Start-End: 31-489
agcccccgcagccctagagccgcccaagggatggcgatggcgtacttggcttggagactggcgcggcgttcgtgtccgagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggtgttagttattagtatagtaactttctcaaagtgcttattcattgaccatgggctgaggttgtttgtcatcgtccgttcaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaagctt

SEQ ID NO: 129999 - DNA, 1405 bp, Homo sapiens
  Payload ID: 5428
  Gene Symbol: ECI2
  Gene Name: enoyl-CoA delta isomerase 2
  ENST ID: ENST00000380125
  CDS Start-End: 130-1224
ggataccgctgtccaggcgaaggtcgccgccgttggaagaccctccttccctattgtctaggtggcaacaggattttgctttgctggttttccggtgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaagcttaagaattca

SEQ ID NO: 130000 - DNA, 1451 bp, Homo sapiens
  Payload ID: 5428
  Gene Symbol: ECI2
  Gene Name: enoyl-CoA delta isomerase 2
  ENST ID: ENST00000496241
  CDS Start-End: 112-534
gagcccccgcagccctagagccgcccaagggatggcgatggcgtacttggcttggagactggcgcggcgttcgtgtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgaggaaggttggtaattgtggctacttcatacaacagagttgagcattcattgtttagagtttgtgaatttcagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaagcttaa

SEQ ID NO: 130001 - DNA, 814 bp, Homo sapiens
  Payload ID: 5428
  Gene Symbol: ECI2
  Gene Name: enoyl-CoA delta isomerase 2
  ENST ID: ENST00000495548
  CDS Start-End: 155-814
tgtccaggcgaaggtcgccgccgttggaagaccctccttccctattgtctaggtggcaacaggattttgctttgctggttttccggtgaggtagtgctaaaaagtgacgacctcacgcgcgccctcctgcaccgctgggcccggagtggtcaggatgggcgcgtcgggaggtcagggctatggttccctgtcagcagtccccaaggtctccgcctgcctccgcgcacgctcccatcctcctggggccggactccgggcgggtgagccgccccagctgagcacccgggcctgcacttcccagccgggctgcttctggggtgcaaagcgtcgcttgctaaaagcgagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatg

SEQ ID NO: 130002 - DNA, 1133 bp, Homo sapiens
  Payload ID: 5428
  Gene Symbol: ECI2
  Gene Name: enoyl-CoA delta isomerase 2
  ENST ID: ENST00000478266
  CDS Start-End: 5-598
agggatggcgatggcgtacttggcttggagactggcgcggcgttcgtgtccgagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaa

SEQ ID NO: 130003 - DNA, 1548 bp, Homo sapiens
  Payload ID: 5428
  Gene Symbol: ECI2
  Gene Name: enoyl-CoA delta isomerase 2
  ENST ID: ENST00000465828
  CDS Start-End: 287-1381
gcgatggcgtacttggcttggagactggcgcggcgttcgtgtccgaggtaagcttggagtcccggccgttcggcccatggtcgcccgcaggataccgctgtccaggcgaaggtcgccgccgttggaagaccctccttccctattgtctaggtggcaacaggattttgctttgctggttttccggtgaggtagtgctaaaaagtgacgacctcacgcgcgccctcctgcaccgctgggcccggagtgttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaaca

SEQ ID NO: 130004 - DNA, 308 bp, Homo sapiens; identical to SEQ ID NO: 129979
  Payload ID: 5429
  Gene Symbol: ECH1
  Gene Name: Enoyl-CoA hydratase 1, peroxisomal
  ENST ID: ENST00000635053
  CDS Start-End: 257-308

SEQ ID NO: 130005 - DNA, 209 bp, Homo sapiens; identical to SEQ ID NO: 129974
  Payload ID: 5429
  Gene Symbol: ECH1
  Gene Name: Enoyl-CoA hydratase 1, peroxisomal
  ENST ID: ENST00000634309
  CDS Start-End: 1-209

SEQ ID NO: 130006 - DNA, 677 bp, Homo sapiens; identical to SEQ ID NO: 129976
  Payload ID: 5429
  Gene Symbol: ECH1
  Gene Name: Enoyl-CoA hydratase 1, peroxisomal
  ENST ID: ENST00000635068
  CDS Start-End: 11-124

SEQ ID NO: 130007 - DNA, 440 bp, Homo sapiens; identical to SEQ ID NO: 129973
  Payload ID: 5429
  Gene Symbol: ECH1
  Gene Name: Enoyl-CoA hydratase 1, peroxisomal
  ENST ID: ENST00000634273
  CDS Start-End: 332-440

SEQ ID NO: 130008 - DNA, 169 bp, Homo sapiens; identical to SEQ ID NO: 129977
  Payload ID: 5429
  Gene Symbol: ECH1
  Gene Name: Enoyl-CoA hydratase 1, peroxisomal
  ENST ID: ENST00000634714
  CDS Start-End: 4-169

SEQ ID NO: 130009 - DNA, 560 bp, Homo sapiens; identical to SEQ ID NO: 129975
  Payload ID: 5429
  Gene Symbol: ECH1
  Gene Name: Enoyl-CoA hydratase 1, peroxisomal
  ENST ID: ENST00000635118
  CDS Start-End: 18-560

SEQ ID NO: 130010 - DNA, 1411 bp, Homo sapiens; identical to SEQ ID NO: 129972
  Payload ID: 5429
  Gene Symbol: ECH1
  Gene Name: Enoyl-CoA hydratase 1, peroxisomal
  ENST ID: ENST00000634245
  CDS Start-End: 234-1220

SEQ ID NO: 130011 - DNA, 799 bp, Homo sapiens; identical to SEQ ID NO: 129978
  Payload ID: 5429
  Gene Symbol: ECH1
  Gene Name: Enoyl-CoA hydratase 1, peroxisomal
  ENST ID: ENST00000634770
  CDS Start-End: 1-799

SEQ ID NO: 130012 - DNA, 3850 bp, Homo sapiens
  Payload ID: 5430
  Gene Symbol: EHHADH
  Gene Name: enoyl-CoA, hydratase/3-hydroxyacyl CoA dehydrogenase
  Uniprot ID: Q08426
  ENST ID: ENST00000231887
  CDS Start-End: 77-2248
gaggaggccgggcgcgcccggaaaagtggtttgcctgacggcgagaggcagaggtgccctcggtgatagaggaaacatggccgagtatacgcggctgcacaacgccttggcgctaatccgcctccgaaacccgccggtcaacgcgatcagtacgactttactccgtgacataaaagaaggactacagaaagctgtaatagaccatacaataaaagccattgtgatttgtggagcagagggcaaattttctgcaggtgctgatattcgtggcttcagtgctcctaggacatttggccttacactgggacatgtagtagatgaaatacagagaaatgagaagcccgtggtggcagcaatccaaggcatggctttcggagggggactagagctggccctgggctgtcactataggattgcccacgcagaggctcaagttggcttaccagaagttacactgggacttctccctggtgcaagaggaacccagcttctccccagactcactggagttcctgctgcacttgacttaattacctcaggaagacgtattttagcagatgaagcactcaagctgggcattctagataaagttgtaaactcagacccggttgaagaagcaatcagatttgctcagagagtttcagatcaacctctagaatcccgtagactctgcaacaagccaattcagagcttgcccaacatggacagcatttttagtgaggccctcttgaagatgcggaggcagcaccctgggtgtcttgcacaggaggcttgtgtccgtgcagtccaggctgctgtgcagtatccctatgaagtgggcatcaagaaggaggaggagctgtttctatatcttttgcaatcagggcaggctagagccctgcaatatgctttcttcgctgaaaggaaagcaaataagtggtcaactccctccggagcatcgtggaaaacagcatcagcgcggcctgtctcctcagttggtgttgttggcttgggaacaatgggccgaggcattgtcatttcttttgcaagggccaggattcctgtgattgctgtagactcggacaaaaaccagctagcaactgcaaacaagatgataacctctgtcttggaaaaagaagcctccaaaatgcaacagagcggccacccttggtcaggaccaaaacccaggttaacttcatctgtgaaggagcttggtggtgtagatttagtcattgaagcagtatttgaggaaatgagcctgaagaagcaggtctttgctgaactctcagctgtgtgcaaaccagaagcatttttgtgcactaatacttcagccctggatgttgatgagattgcttcttccactgatcgtcctcacttggtcattggcacccacttcttttcgccagctcatgtcatgaagttgttagaggttattcccagccaatactcttcccccactaccattgccactgttatgaacttatcaaaaaagattaaaaagattggagtcgttgtaggcaactgttttggatttgtggggaatcgaatgttgaatccttactacaatcaggcatatttcttgttagaagaaggcagcaaaccagaggaggtagatcaggtgctggaagagtttggttttaaaatgggaccttttagagtgtctgatcttgctgggttggatgtgggctggaaatctagaaaggggcaaggtcttactggacctacattgcttccaggaactcctgcccgaaaaaggggtaataggaggtactgcccaattcctgatgtgctctgtgaattaggacgatttggccagaagacaggtaagggttggtatcaatatgacaagccattgggtaggattcacaaacctgatccctggctttccaaattcctatcacggtatagaaaaacccatcacattgaaccacgtaccattagccaggatgagatccttgaacgctgcttatattcacttatcaatgaagcattccgtatcttgggagaagggatagctgctagcccagagcacattgatgttgtctatttacatggatatggatggccaaggcacaagggcgggcccatgttctatgcttccacagttgggttgcccacagttctagagaaattgcagaaatattacaggcagaaccctgatattccccaactggagccaagtgactatctaaaaaaactggcttctcagggaaaccctcccctgaaagaatggcaaagcttggcaggctcccctagcagtaaattgtgattcagtcttccagattatgcctcacatgctagcatcaggtaatgctgactgaatttcagtgaaattaaatcaaaaatccaaagtaagattgttctgaaatacaaagcaaaataaataatcattagaatcttctgtgtaacgactctaatggtcaaatctttaggaatgtgcttcctatgcctctgaatctgtccttatcagataaattcaatgcatgaacttgtgtgaatataataccataatagctaatgaaagaggctcaggcataagttgagattctcaaatgcttttatcattggataaatgtgtcatcaattaataaatgataaatgcagctaagtcatacattcattttgactcctttcaatgtcacacacatagtattgatcagaaatcttatgaatcatacatacactcaacaaacattaaagttgtaggaaaaagacagttggaaattggtaagggaactgagtacttcaaaccagcacagggaacttaggttagtgtggcaagcctttcctcttctggtctttcctcttctgtttatggagaaataatagaaagtagtaagtcgttaacttagtgtaagaagggtcttagagaacatctaaccttctaggatttcccaattctgtgatagagtaatgacaccagttttcctgtcatgacaagcctctgtgatgttacatatggaaatggttgaatcttgaaaaatctaaaattgttgcaaaacatattttgtatgattttgttgtaagagttcttctctttttactttttgccttgtgtagttaaaaattaaggggctggtcaatacaaaaacttgtacacaaatatttatagcagaattattcataatggccaaaagctgaatacaacccaaatgtctatgaactaatgaatagataaaccaaatctggtatatccatacaatggactatattattcagccataaaaagaaataaagggccaggcacagtggctcacacctgtaatcccagcactttgggaggctgaggcaggaggattgtttgaggccagaaatttgagaccagcctgggcaacatagcaaaaccctgtctctacaaaaaatactttccgtacattagtggttgcctaaggctagaattgggggtgatgaatggggagtacaggattcatctaatgggtacaggatttctttatggttcatgaaaatggtctaaacttattgtggtaatggtcacataacaatatattaaaaaccattgagttgtatattttaagtgggtgaattatatggtatgtgaattatatctcaataaagttgttagtaaataaatggggctgaagatgttatccttcattgtggtgtaaatgaactttcacaatattttcacctgtgaacccaaataaaatgattaaagttctgatggaaaaatcttgaatggagtataagttttccgttgttaaaaagcaaacaaaaaaccaacaaaaaatccaagtgtgccttgaattgtacagagcacaattattatgtttgaaatgtgtactacttaattttatataatttggtttgtgaaattaaagacatcaataaaaatgattcctgaaagtagtaa

SEQ ID NO: 130013 - DNA, 2577 bp, Homo sapiens
  Payload ID: 5430
  Gene Symbol: EHHADH
  Gene Name: enoyl-CoA, hydratase/3-hydroxyacyl CoA dehydrogenase
  Uniprot ID: Q08426
  ENST ID: ENST00000456310
  CDS Start-End: 438-2321
gaggtgccctcggtgatagaggaaacatggccgagtatacgcggctgcacaacgccttggcgctaatccgcctccgaaacccgccggtcaacgcgatcaggtaacgggctcggtcgcctccagcccggggaccgtgcgggccttagccgccctctggctccggaggctttgactctcccccgtcggtttaaaccgagaaggacactcaagagttgagcaactgtacgactttactccgtgacataaaagaaggactacagaaagctgtaatagaccatacaataaaagccattgtgatttgtggagcagagggcaaattttctgcaggtgctgatattcgtggcttcagtgctcctaggacatttggccttacactgggacatgtagtagatgaaatacagagaaatgagaagcccgtggtggcagcaatccaaggcatggctttcggagggggactagagctggccctgggctgtcactataggattgcccacgcagaggctcaagttggcttaccagaagttacactgggacttctccctggtgcaagaggaacccagcttctccccagactcactggagttcctgctgcacttgacttaattacctcaggaagacgtattttagcagatgaagcactcaagctgggcattctagataaagttgtaaactcagacccggttgaagaagcaatcagatttgctcagagagtttcagatcaacctctagaatcccgtagactctgcaacaagccaattcagagcttgcccaacatggacagcatttttagtgaggccctcttgaagatgcggaggcagcaccctgggtgtcttgcacaggaggcttgtgtccgtgcagtccaggctgctgtgcagtatccctatgaagtgggcatcaagaaggaggaggagctgtttctatatcttttgcaatcagggcaggctagagccctgcaatatgctttcttcgctgaaaggaaagcaaataagtggtcaactccctccggagcatcgtggaaaacagcatcagcgcggcctgtctcctcagttggtgttgttggcttgggaacaatgggccgaggcattgtcatttcttttgcaagggccaggattcctgtgattgctgtagactcggacaaaaaccagctagcaactgcaaacaagatgataacctctgtcttggaaaaagaagcctccaaaatgcaacagagcggccacccttggtcaggaccaaaacccaggttaacttcatctgtgaaggagcttggtggtgtagatttagtcattgaagcagtatttgaggaaatgagcctgaagaagcaggtctttgctgaactctcagctgtgtgcaaaccagaagcatttttgtgcactaatacttcagccctggatgttgatgagattgcttcttccactgatcgtcctcacttggtcattggcacccacttcttttcgccagctcatgtcatgaagttgttagaggttattcccagccaatactcttcccccactaccattgccactgttatgaacttatcaaaaaagattaaaaagattggagtcgttgtaggcaactgttttggatttgtggggaatcgaatgttgaatccttactacaatcaggcatatttcttgttagaagaaggcagcaaaccagaggaggtagatcaggtgctggaagagtttggttttaaaatgggaccttttagagtgtctgatcttgctgggttggatgtgggctggaaatctagaaaggggcaaggtcttactggacctacattgcttccaggaactcctgcccgaaaaaggggtaataggaggtactgcccaattcctgatgtgctctgtgaattaggacgatttggccagaagacaggtaagggttggtatcaatatgacaagccattgggtaggattcacaaacctgatccctggctttccaaattcctatcacggtatagaaaaacccatcacattgaaccacgtaccattagccaggatgagatccttgaacgctgcttatattcacttatcaatgaagcattccgtatcttgggagaagggatagctgctagcccagagcacattgatgttgtctatttacatggatatggatggccaaggcacaagggcgggcccatgttctatgcttccacagttgggttgcccacagttctagagaaattgcagaaatattacaggcagaaccctgatattccccaactggagccaagtgactatctaaaaaaactggcttctcagggaaaccctcccctgaaagaatggcaaagcttggcaggctcccctagcagtaaattgtgattcagtcttccagattatgcctcacatgctagcatcaggtaatgctgactgaatttcagtgaaattaaatcaaaaatccaaagtaagattgttctgaaatacaaagcaaaataaataatcattagaatcttctgtgtaacgactctaatggtcaaatctttaggaatgtgcttcctatgcctctgaatctgtccttatcagataaattcaatgcatgaacttgtgtgaatataataccataatagctaatgaaaga

SEQ ID NO: 130014 - DNA, 656 bp, Homo sapiens
  Payload ID: 5430
  Gene Symbol: EHHADH
  Gene Name: enoyl-CoA, hydratase/3-hydroxyacyl CoA dehydrogenase
  ENST ID: ENST00000440662
  CDS Start-End: 10-240
agaggaaacatggccgagtatacgcggctgcacaacgccttggcgctaatccgcctccgaaacccgccggtcaacgcgatcagtacgactttactccgtgacataaaagaaggactacagaaagctgtaatagaccatacaataaaagccattgtgatttgtggagcagagggcaaattttctgcaggtaactcaagtctaaccctctcccaccatctctggaatccagccacagactgagaccaatactgcattagctgtgcttgttggtaataacttagtgtaggtaatggatatggcagacttgagtgagaatgagtaacactgtggagaaagggacaggaattacaagagagacccagagaagggcttagtctcttttattgtggattgggcttttagagtatatttagttccagacttgatggctgttatacacctgctgatatatacctgcattgcatgtatctccaccatatgtgggcttgggcaaatctctttaacttcctgaacctcaatttctctatctataaagtgggaacaataatatctattttaaggggtttttgtgacattaagcgagataacatatctgaaagcctctactacagtacctacacaaagaagatggtcaataaatgttattgtttaattca

SEQ ID NO: 130015 - DNA, 2710 bp, Homo sapiens
  Payload ID: 5431
  Gene Symbol: ENTHD1
  Gene Name: ENTH domain containing 1
  Uniprot ID: Q8IYW4
  ENST ID: ENST00000325157
  CDS Start-End: 252-2075
ggggaccggcctgggcccttgagcctggctggagtaggtggaatatcctggggagaggaagtttggtcgttgggcagcggccgactttcctctcaggaaattgatactttatcaacatagagattaattatttgtatttgggagcagcagaactggggaccaattacctgtcaagagttttataaacccgtgacataaactgttattccattgctttcatcctccatctcaccttggaacttgtattacttatggcgttcaggagacaagtgaaaaactttgtgaaaaattactcagatgctgaaataaaagtcagggaagcaacttctaacgacccttggggtccctctagttctctgatgttagatatcagtgacttgactttcaacacaatttctctctcagagattatgaatatgctgtggcacagactcaatgaccatgggaagaactggcgccacgtgtataaatcccttaccctaatggattatctcatcaagaatggatcaaagaaagttattcagcattgcagagaggggttctgtaaccttcaaacactaaaagattttcagcacatagatgaagctggaaaagaccaaggttattatatccgggaaaaatctaagcaagtcatcacattgctgatggatgaaccattgctgtgtaaagagagggaagtggcatgtcggactagacagcgtacctcccactctatattgttttctaaaagacaacttggttcaagtaactcactgacagcgtgcacttctgcccccacaccggatatttctgcttcagagaagaagtataagcttcctaagtttggaaggttacataataaaagaaatgtgtgcaaggcaggattgaaacaagagcattgccaagatgttcatttgcctacagaaactatgttgtcccaggaaacacttccactcaagattcatggttggaaatcaacagaggacctgatgacatttttggatgatgatccagagctgcctttactagcaacacctccttccattgtctctccaatcacttgcttgtcagaagcagaagaagtttgtaatctttcgggtgcagatgctgtgcctactctctcagaaaatagtccttctgggcagagagatgtgagtttggacaagagatcagatggtatctttacaaatactgtcacagaaaacctcttggaaacacctttagaaaagcaatcagctgcagaaggtcttaaaacattgacaattttaccagcatgttggtcaagtaaagaggagtttatcagccccgacttaagggtatcaaagtcagattctactttccataaccaggcctctgtagaaacactctgtctctctccctcattcaaaatatttgaccgagtgaaggagattgtaatcaacaaggcctaccagaaaccagcacaatccagcattcagatggatgataaaatcctcaagacaaccacacgggtttcaactgcttctgagggagcatcttccttttctcctttatccatgtcatctcctgatttagcctctccagagaagtcagctcatctcttatcaccaattctggccggaccttccttctggactctgtcccatcaacagttgtcttctacctcctttaaagatgaagataagacagccaagctgcatcactcctttgcttctaggggcccagtgtcttctgatgtagaggaaaatgatagcctcaatctactgggaattcttccaaataactctgattctgctaaaaagaatataagtcacatttctagtagtcactggggggagttttccacccaaaatgtagaccagttcatccctctgtcctgttctggttttcagtcaaccaaagacttcccccaggaacctgaagcaaagaattccattagtgttcttttaagggaggtaaaacgtgcgatcgctagattacatgaagatctgagcacagtgatccaagaacttaatgtcatcaataacatcttgatgagcatgagtctgaatagttcacaaataagccagtcttcccaggtcccccagtcttctgaggggagctcagatcagatctaatcatcacaatatctatttttgatagaactcgtgtggttccacttccccaagacttacgttagcattgtataaattcatattattatggcaaaaaaggggatggtttaatttttccttgtcaggtttattagcaagtatctttcaaactaatactttcatttgggtggtttattttttaaaagggaaagatgtcacctttgataatttcagatttagatattagttcatttgaaacagaagagaatttcattctttcatgctctgtacctcaaatgggttaagcattagtgaaaattgtggtaagacctcaaactgcaaatgactattcaagagcttttggataaggaggcaggaagaagctctttatctttcaactgtatggagcttgttaacaagcctctgaggtgacctaggaggattgagtttgggggtatacatttcacacattcttttgcaagttttaggttctgcaaccaagggccagaaatcttttctttcttccagatgctagtgttaggagttaaatggaaacaagaaggacatggggcaaatgtttttactgtcaatgtatattgcaaggtgaattcaaatgcatccttttattctacttcagaaaataaatttgatatttttca

SEQ ID NO: 130016 - DNA, 2287 bp, Homo sapiens
  Payload ID: 5432
  Gene Symbol: ENTHD2
  Gene Name: ENTH domain containing 2
  Uniprot ID: Q96N21
  ENST ID: ENST00000300714
  CDS Start-End: 59-1636
agtgattggagggcccgggcctggcggaagcggggcagaccgggaggggacctggatcatggctgccgcgccgccgctacgggaccgcctgagctttctacaccggctcccgattctcctgaaggggacgtccgatgatgatgtcccgtgtccgggctacctgtttgaagagattgctaaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtaccagaaggttcgcgcggccgcgcaggacttggggagcaccctgttctcggacaccgtgttgccgctggctccctcccagcctctggggaccccgcctgccacaggcatgggctcccaggccaggccgcacagcaccctccagggtttcggctacagcaaggaacacggccgcacggctgtgaggcatcagcctgggcaggccggagggggctgggatgagctggacagcggccccagctctcagaattcctcccagaacagcgacctgagcagggtctcggactcgggcagtcattccggcagcgacagccattcaggggccagccgggagccgggtgacctggcagaaagggtcgaggtggtggccctgagtgactgtcagcaggagttgagcttggtgaggactgtgactcggggaccacgcgccttcctgagccgcgaggaggcacagcacttcatcaaagcgtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgcgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgctctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatgaa

SEQ ID NO: 130017 - DNA, 551 bp, Homo sapiens
  Payload ID: 5432
  Gene Symbol: ENTHD2
  Gene Name: ENTH domain containing 2
  ENST ID: ENST00000571115
  CDS Start-End: 1-158
ccctgagtgactgtcagcaggagttgagcttggtgaggactgtgactcggggaccacgcgccttcctgagccgcgaggaggcacagcacttcatcaaagcgtgtcccctctgtgcaggtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgccca

SEQ ID NO: 130018 - DNA, 849 bp, Homo sapiens
  Payload ID: 5432
  Gene Symbol: ENTHD2
  Gene Name: ENTH domain containing 2
  ENST ID: ENST00000570854
  CDS Start-End: 25-576
gcagaccgggaggggacctggatcatggctgccgcgccgccgctacgggaccgcctgagctttctacaccgggtgagtgagggcggtccgcccgggccccggtcccacggctcctctcgagcgccgcattccccggactcgccccgggccggagccattgaccttgcgtctccgcgccgggtagctgctcctggccccttcgcccgcgccgacgcccctgagctgcccgcccgccgcgccgtcccggggccttccaagccgggccttccaagccggacccgccgagcgcaagggcgatgggcacagccagaccctgggggaacgaacaggcctcggccagcattcagtggcctccgacgggagggaaggagcggcggacccggtggacgtggagccgctgtgtccgtgctgctggcgcccaggtgggctggcagcccgccgtcctccctgacggtggcgtttcagaggactccggtcctggagaggcacccctgggttgcagagaacacagacgtctcgaagggacagagaaggacgcaccattctcccgattctcctgaaggggacgtccgatgatgatgtcccgtgtccgggctacctgtttgaagagattgctaaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtacca

SEQ ID NO: 130019 - DNA, 568 bp, Homo sapiens
  Payload ID: 5432
  Gene Symbol: ENTHD2
  Gene Name: ENTH domain containing 2
  ENST ID: ENST00000572050
  CDS Start-End: 1-292
ggaccgcctgagctttctacaccggctgctcctggccccttcgcccgcgccgacgcccctgagctgcccgcccgccgcgccgtcccggggccttccaagccgggccttccaagccggacccgccgagcgcaagggcgatgggcacagccagaccctgggggaacgaacaggcctcggccagcattcagtggcctccgacgggagggaaggagcggcggacccggtggacgtggagccgctgtgtccgtgctgctggcgcccaggtgggctggcagcccgccgtcctccctgacggtggcgtttcagaggactccggtcctggagaggcacccctgggttgcagagaacacagacgtctcgaagggacagagaaggacgcaccattgctgttcatccctgactgttgagagaggaccctgctgcagcctccctgtggccagtagcacagttctcatcccttcccagtcctctctccggccatgtcaacagtgagagctcccgattctcctgaaggggacgtccgatgatgatgtcccgtgtccgggctacctgtttgaagagattgcta

SEQ ID NO: 130020 - DNA, 453 bp, Homo sapiens
  Payload ID: 5432
  Gene Symbol: ENTHD2
  Gene Name: ENTH domain containing 2
  ENST ID: ENST00000571094
  CDS Start-End: 113-453
gttctcatcccttcccagtcctctctccggccatgtcaacagtgagaggtgggtcgtttccatcccctttggggggctgcggattcacccctgtgggaaatggcacctcatcatggtaggggctcttgttccctttcagctcccgattctcctgaaggggacgtccgatgatgatgtcccgtgtccgggctacctgtttgaagagattgctaaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtaccagaaggttcg

SEQ ID NO: 130021 - DNA, 6614 bp, Homo sapiens
  Payload ID: 5433
  Gene Symbol: EVPL
  Gene Name: envoplakin
  Uniprot ID: Q92817
  ENST ID: ENST00000301607
  CDS Start-End: 255-6356
agactggttgtgcaggaggaggcatgagtgtggccgttgtgggtgcatgcgcgtcaggcctgggacccggccgcccgcccgctgcctcacctgcaaggaggggcctcccagaaactcccttccccagtgcccagccgccccacctcgccagacttagctgaccagccagtgaggacgcccgctgcctcccacctgccctcctgccgtctttcgccagccaagcccagcctgagccagcacttgcctttacgaccatgttcaaggggctgagcaaaggctcccaggggaaggggtcccccaagggctcccccgccaaggggtcccccaaaggctcccccagcaggcacagccgggctgccacccaggagctggcccttctcatctcccgcatgcaagccaacgccgaccaggtggagcgggacatcctggagacgcagaagaggctgcagcaggaccggctgaacagtgagcagagccaggccctgcagcaccagcaggagacgggccgcagcctgaaggaggctgaggtgctgctcaaggacctcttcctggacgtggacaaggcccggcggctcaagcacccgcaggctgaggagattgagaaggacatcaagcagctgcacgagcgggtgacccaggagtgtgcggagtaccgtgccctgtacgagaagatggtgctgccccccgacgtgggacccagggtcgactgggcacgcgtgctggagcagaaacagaagcaggtctgcgcaggccagtacgggccgggcatggcggagctggagcaacagatcgccgagcacaacatcctgcagaaggagatcgacgcctatgggcagcagctgcggagcctcgtggggccggatgcagccaccatccggagccaataccgagacctactgaaggcggcgtcgtggcgcgggcagagcctgggcagcctgtacacgcacctccagggctgcacgcggcagctgagcgccctggctgagcagcagcgccgcatcctgcagcaggactggagcgacctcatggccgaccctgcgggcgtgcggcgggagtacgagcacttcaagcagcacgagctgctgagccaggagcagagcgtgaaccagctggaggacgacggcgagcgcatggtggagctgcggcaccccgcggtggggcccatccaggcccaccaggaggccctgaagatggagtggcagaacttcctgaacctgtgtatctgccaggagacccagctgcagcacgtggaggactaccgccggttccaggaagaggccgactcagtcagccagaccctggcgaagctcaactccaacttggatgccaagtacagccctgcacctgggggcccccctggcgcccccacagagctgctgcaacagctggaggcagaggaaaaacggctggccgtcaccgagagggccactggggacctgcagcggcgaagccgggatgtggcccctctgccacagcgaagaaacccccctcagcagcccctgcacgtggacagcatctgcgactgggactcaggagaagtgcagctgctgcagggtgagcggtataagctggtagataacactgacccgcacgcctgggtcgtgcagggccctggcggggagaccaagcgtgctcccgccgcctgcttctgcatcccagcaccagaccctgatgctgtggccagggcctcccggctggcctcagagctgcaggccctgaagcagaaattggccacagtccagagccgcctgaaggccagtgctgtggagtctcttcggcccagccagcaggctccatctggctcagacctggccaacccacaggcccagaagctcctgacacagatgacccggctggatggagacctgggacagatagagaggcaggtgctggcctgggcgcgggccccgctgagccgccccacacccttggaggacttggagggccgcatccacagccatgagggcacagcccagcgcctgcagagcctgggaacggagaaggagacagcccagaaggagtgcgaggcgtttctgtccacgcggcccgtgggccccgctgccctgcagctgcccgtagccctcaacagcgtgaagaacaagttcagtgacgtgcaggttctgtgcagcctctacggggagaaagccaaggctgccctggatctggagcggcagatccaggatgcggacagggtcatccgaggcttcgaggccaccctggtgcaggaggcccccatccctgctgaaccgggggctctgcaggagagggtcagcgagctgcagcgccagcggagggagctgctggaacagcagacctgcgtgctgcggctacaccgcgcgctgaaggcctcggagcacgcatgcgctgccctgcagaacaacttccaggagttctgccaagacctgcctcgccagcagcgccaggtgcgagccctcaccgaccgctaccacgccgtaggggaccagctggacctgcgggagaaggtggtgcaggatgccgccctcacctaccagcagttcaagaactgcaaggataacctgagctcctggctggagcacctgccccgcagccaggtgcggcccagcgacggccccagccagatcgcctacaagctgcaggcgcagaagaggctgacgcaggagatccagagccgagagcgggacagggccacagcatcccacctctcccaggccctgcaggcagcgctccaggactatgagctccaggcagacacctaccgctgctctttggagcccaccctggcagtgtcagcccccaagagaccccgagtggctcccctgcaagagagcatccaagcccaggagaagaaccttgcaaaggcctatactgaggttgcagcagcacagcagcagctgctccagcagctggagtttgctagaaaaatgctggagaagaaggagctcagtgaggacatccgaaggacccatgatgcaaagcagggctccgagagccctgcccaagcagggagagagtcagaggccctgaaggcccagctggaagaggagaggaagcgggtggcccgggtgcagcatgagctggaggcgcagaggagccaactgctgcagctgaggacccagcggcccttggagaggctggaggagaaggaagtggtagagttctaccgggacccccagctggagggcagcctgtccagggtgaaggcccaggtggaggaggagggcaagcggcgggctggcctgcaggcagacctggaagtggcagcccagaaggtcgtgcagctggaaagcaagaggaagaccatgcagcctcatctgctgaccaaggaggtcacccaggtggagagggaccccggcctggacagccaggcggcccagctcaggatccagatccagcagctccgcggggaggatgccgtcatctcggcccggctggaagggctgaagaaggagctactggcccttgagaagagggaggtggacgtgaaggagaaggtcgtggtgaaagaggtagtcaaggtggagaagaatctggaaatggtcaaggcagcccaggctctgaggctgcagatggaggaggatgctgcgcggaggaagcaggcggaggaggctgtggccaagctacaggctcgcatcgaagacctggagcgggctatcagctcggtggagcccaaggtcatcgtgaaggaggtgaagaaggtggagcaggacccagggctcctccaggagtcctccaggctgaggagcctcctcgaggaggagaggaccaagaacgcgacgctggccagggagctgagcgacctgcacagcaagtacagcgtggtggagaagcagaggcccaaagtgcagctccaggagcgcgtccacgagatcttccaggtggatccggagacagagcaggagatcactcggctcaaggccaagctgcaggagatggcgggcaagaggagcggtgtggagaaggaggtggagaagctgctgcccgacctggaggtcctgcgggcccagaagcccacggtggagtacaaggaggtgacccaggaggtggtgaggcatgagaggagccccgaggtgctgcgtgagatcgaccgcctgaaggctcagctcaacgagctcgtcaacagccacgggcgctcccaggagcagctcatccgcctgcagggtgagcgcgacgagtggaggcgcgagcgggccaaggtggagaccaagacggtgagcaaggaggtggtgcgccacgagaaggacccggtgctggagaaagaagcagagcggctccgccaggaggtgcgggaggcggcccagaagaggcgggccgcggaggacgcggtgtacgagctgcagagcaagcgcctgctgctggagaggaggaagcccgaggagaaggtggtggtgcaggaggtggtggtcacccagaaggacccgaagctgcgcgaggagcacagccggctgagcgggagcctggatgaggaggtgggccggcggcgccagctagagcttgaggtgcagcagctgcgggccggcgtggaggagcaggagggcctgctcagcttccaggaggaccgcagcaagaagctggccgtggagagggagctgcggcagctgaccttgaggatccaggagctcgagaagcggcctcccacggtgcaggagaagatcatcatggaggaagtggtcaagctggagaaggacccggacctggagaagtccacggaagccctgcggtgggacctggaccaggagaagacccaggtaaccgagctgaatcgggagtgcaagaacctgcaggtccagattgacgtcctccagaaagccaaatcgcaggagaagaccatctacaaggaagtgatccgggtgcagaaggaccgcgtcctggaagatgagcgggcccgcgtgtgggagatgctcaacagggagcgcacggcccggcaggcccgggaggaggaggcacggcgcctgcgggagcgcattgaccgggccgagacgctggggagaacctggtcccgggaggagtccgagctgcagagggcccgggaccaggccgaccaggagtgtgggcggctgcagcaggagctgcgggctctggagaggcagaagcagcagcagacactgcagctgcaggaggagtcgaagctgctcagccagaagacggagagcgagcgacagaaggcggcccagcggggccaggagctctcgcggctggaggcggccatcctccgcgagaaggaccagatctacgagaaggagcggacgctccgggacctccacgccaaggtgagccgggaggagctcagccaggagacccagacgcgagagaccaacctttccaccaagatctccatcctggaacccgagacggggaaggacatgtccccatacgaggcctacaagaggggcatcatcgacaggggccagtacttgcagctgcaggagctcgagtgtgactgggaggaggtcaccacctcggggccctgtggggaggagtctgtgctcctggaccgcaagagcgggaagcagtactccatcgaggccgccctccgctgccggcgcatctctaaggaggagtaccatctgtacaaggacggccacctgcccatctccgagtttgcgctgcttgtagctggggagaccaagccaagctcctcactctccatcggctctatcatctccaagtccccgctcgcctccccggccccccagagcaccagtttcttctctcccagcttctctctcgggctcggtgatgacagcttccctatcgccgggatctatgacacaaccacagacaacaagtgcagcatcaagacggccgtggccaagaacatgctggaccccatcactgggcagaagctactggaggcccaggcggccacagggggcatcgtggacctgctcagccgtgagcgctactctgtgcacaaggcgatggagaggggcctgatcgagaacacctccacacagaggctgcttaacgcccagaaggccttcaccggcatcgaggaccccgtcaccaagaagaggctctcggtgggcgaggccgtccagaagggctggatgccccgggagagcgtgctcccacacctgcaggtgcagcacctgaccggggggctcatcgaccccaagaggacaggccgcatccccatccagcaggccctcctctccgggatgatcagtgaagagctggcccagctcctgcaggacgagtccagctacgagaaggatttgacagaccccatctccaaggaacggctgagctacaaggaggccatgggccgctgccgcaaagaccccctgagcggcctgctgctcctgccagcggcactggaggggtaccgctgctaccgctccgcctcccccaccgtcccgcgctcccttcgctgacacgggccaaggagccagtggggaagtgcgtgtgttgggccaggtaggatacgtacacctcttgcctcagagcagcctcatcccaggcagtgggtcttccctctgtccaaccactgttttattattttactaacatggtgatgggctccctcccctaaccttggtgcctgatccatccccagaccaggacagcagccactcagttcttcctccacctccacccagtgatcccaataaacgaattctgtctccccgtgc

SEQ ID NO: 130022 - DNA, 6223 bp, Homo sapiens
  Payload ID: 5433
  Gene Symbol: EVPL
  Gene Name: envoplakin
  ENST ID: ENST00000586740
  CDS Start-End: 34-6201
gcccagcctgagccagcacttgcctttacgaccatgttcaaggggctgagcaaaggctcccaggggaaggggtcccccaagggctcccccgccaaggggtcccccaaaggctcccccagcaggcacagccgggctgccacccaggagctggcccttctcatctcccgcatgcaagccaacgccgaccaggtggagcgggacatcctggagacgcagaagaggctgcagcaggaccggctgaacagtgagcagagccaggccctgcagcaccagcaggagacgggccgcagcctgaaggaggctgaggtgctgctcaaggacctcttcctggacgtggacaaggcccggcggctcaagcacccgcaggctgaggagattgagaaggacatcaagcagctgcacgagcgggtgacccaggagtgtgcggagtaccgtgccctgtacgagaagatggtgctgccccccgacgtgggacccagggtcgactgggcacgcgtgctggagcagaaacagaagcaggtctgcgcaggccagtacgggccgggcatggcggagctggagcaacagatcgccgagcacaacatcctgcagaaggagatcgacgcctatgggcagcagctgcggagcctcgtggggccggatgcagccaccatccggagccaataccgagacctactgaaggcggcgtcgtggcgcgggcagagcctgggcagcctgtacacgcacctccagggctgcacgcggcagctgagcgccctggctgagcagcagcgccgcatcctgcagcaggactggagcgacctcatggccgaccctgcgggcgtgcggcgggagtacgagcacttcaagcagcacgagctgctgagccaggagcagagcgtgaaccagctggaggacgacggcgagcgcatggtggagctgcggcaccccgcggtggggcccatccaggcccaccaggaggccctgaagatggagtggcagaacttcctgaacctgtgtatctgccaggagacccagctgcagcacgtggaggactaccgccggttccaggaagaggccgactcagtcagccagaccctggcgaagctcaactccaacttggatgccaagtacagccctgcacctgggggcccccctggcgcccccacagagctgctgcaacagctggaggcagaggaaaaacggctggccgtcaccgagagggccactggggacctgcagcggcgaagccgggatgtggcccctctgccacagcgaagaaacccccctcagcagcccctgcacgtggacagcatctgcgactgggactcaggagaagtgcagctgctgcagggtgagcggtataagctggtagataacactgacccgcacgcctgggtcgtgcagggccctggcggggagaccaagcgtgctcccgccgcctgcttctgcatcccagcaccagaccctgatgctgtggccagggcctcccggctggcctcagagctgcaggccctgaagcagaaattggccacagtccagagccgcctgaaggccagtgctgtggagtctcttcggcccagccagcagggtacccagggtggcccggggagaggtggctgtggggctagaaggagtagattccgacttccgactgctccatctggctcagacctggccaacccacaggcccagaagctcctgacacagatgacccggctggatggagacctgggacagatagagaggcaggtgctggcctgggcgcgggccccgctgagccgccccacacccttggaggacttggagggccgcatccacagccatgagggcacagcccagcgcctgcagagcctgggaacggagaaggagacagcccagaaggagtgcgaggcgtttctgtccacgcggcccgtgggccccgctgccctgcagctgcccgtagccctcaacagcgtgaagaacaagttcagtgacgtgcaggttctgtgcagcctctacggggagaaagccaaggctgccctggatctggagcggcagatccaggatgcggacagggtcatccgaggcttcgaggccaccctggtgcaggaggcccccatccctgctgaaccgggggctctgcaggagagggtcagcgagctgcagcgccagcggagggagctgctggaacagcagacctgcgtgctgcggctacaccgcgcgctgaaggcctcggagcacgcatgcgctgccctgcagaacaacttccaggagttctgccaagacctgcctcgccagcagcgccaggtgcgagccctcaccgaccgctaccacgccgtaggggaccagctggacctgcgggagaaggtggtgcaggatgccgccctcacctaccagcagttcaagaactgcaaggataacctgagctcctggctggagcacctgccccgcagccaggtgcggcccagcgacggccccagccagatcgcctacaagctgcaggcgcagaagaggctgacgcaggagatccagagccgagagcgggacagggccacagcatcccacctctcccaggccctgcaggcagcgctccaggactatgagctccaggcagacacctaccgctgctctttggagcccaccctggcagtgtcagcccccaagagaccccgagtggctcccctgcaagagagcatccaagcccaggagaagaaccttgcaaaggcctatactgaggttgcagcagcacagcagcagctgctccagcagctggagtttgctagaaaaatgctggagaagaaggagctcagtgaggacatccgaaggacccatgatgcaaagcagggctccgagagccctgcccaagcagggagagagtcagaggccctgaaggcccagctggaagaggagaggaagcgggtggcccgggtgcagcatgagctggaggcgcagaggagccaactgctgcagctgaggacccagcggcccttggagaggctggaggagaaggaagtggtagagttctaccgggacccccagctggagggcagcctgtccagggtgaaggcccaggtggaggaggagggcaagcggcgggctggcctgcaggcagacctggaagtggcagcccagaaggtcgtgcagctggaaagcaagaggaagaccatgcagcctcatctgctgaccaaggaggtcacccaggtggagagggaccccggcctggacagccaggcggcccagctcaggatccagatccagcagctccgcggggaggatgccgtcatctcggcccggctggaagggctgaagaaggagctactggcccttgagaagagggaggtggacgtgaaggagaaggtcgtggtgaaagaggtagtcaaggtggagaagaatctggaaatggtcaaggcagcccaggctctgaggctgcagatggaggaggatgctgcgcggaggaagcaggcggaggaggctgtggccaagctacaggctcgcatcgaagacctggagcgggctatcagctcggtggagcccaaggtcatcgtgaaggaggtgaagaaggtggagcaggacccagggctcctccaggagtcctccaggctgaggagcctcctcgaggaggagaggaccaagaacgcgacgctggccagggagctgagcgacctgcacagcaagtacagcgtggtggagaagcagaggcccaaagtgcagctccaggagcgcgtccacgagatcttccaggtggatccggagacagagcaggagatcactcggctcaaggccaagctgcaggagatggcgggcaagaggagcggtgtggagaaggaggtggagaagctgctgcccgacctggaggtcctgcgggcccagaagcccacggtggagtacaaggaggtgacccaggaggtggtgaggcatgagaggagccccgaggtgctgcgtgagatcgaccgcctgaaggctcagctcaacgagctcgtcaacagccacgggcgctcccaggagcagctcatccgcctgcagggtgagcgcgacgagtggaggcgcgagcgggccaaggtggagaccaagacggtgagcaaggaggtggtgcgccacgagaaggacccggtgctggagaaagaagcagagcggctccgccaggaggtgcgggaggcggcccagaagaggcgggccgcggaggacgcggtgtacgagctgcagagcaagcgcctgctgctggagaggaggaagcccgaggagaaggtggtggtgcaggaggtggtggtcacccagaaggacccgaagctgcgcgaggagcacagccggctgagcgggagcctggatgaggaggtgggccggcggcgccagctagagcttgaggtgcagcagctgcgggccggcgtggaggagcaggagggcctgctcagcttccaggaggaccgcagcaagaagctggccgtggagagggagctgcggcagctgaccttgaggatccaggagctcgagaagcggcctcccacggtgcaggagaagatcatcatggaggaagtggtcaagctggagaaggacccggacctggagaagtccacggaagccctgcggtgggacctggaccaggagaagacccaggtaaccgagctgaatcgggagtgcaagaacctgcaggtccagattgacgtcctccagaaagccaaatcgcaggagaagaccatctacaaggaagtgatccgggtgcagaaggaccgcgtcctggaagatgagcgggcccgcgtgtgggagatgctcaacagggagcgcacggcccggcaggcccgggaggaggaggcacggcgcctgcgggagcgcattgaccgggccgagacgctggggagaacctggtcccgggaggagtccgagctgcagagggcccgggaccaggccgaccaggagtgtgggcggctgcagcaggagctgcgggctctggagaggcagaagcagcagcagacactgcagctgcaggaggagtcgaagctgctcagccagaagacggagagcgagcgacagaaggcggcccagcggggccaggagctctcgcggctggaggcggccatcctccgcgagaaggaccagatctacgagaaggagcggacgctccgggacctccacgccaaggtgagccgggaggagctcagccaggagacccagacgcgagagaccaacctttccaccaagatctccatcctggaacccgagacggggaaggacatgtccccatacgaggcctacaagaggggcatcatcgacaggggccagtacttgcagctgcaggagctcgagtgtgactgggaggaggtcaccacctcggggccctgtggggaggagtctgtgctcctggaccgcaagagcgggaagcagtactccatcgaggccgccctccgctgccggcgcatctctaaggaggagtaccatctgtacaaggacggccacctgcccatctccgagtttgcgctgcttgtagctggggagaccaagccaagctcctcactctccatcggctctatcatctccaagtccccgctcgcctccccggccccccagagcaccagtttcttctctcccagcttctctctcgggctcggtgatgacagcttccctatcgccgggatctatgacacaaccacagacaacaagtgcagcatcaagacggccgtggccaagaacatgctggaccccatcactgggcagaagctactggaggcccaggcggccacagggggcatcgtggacctgctcagccgtgagcgctactctgtgcacaaggcgatggagaggggcctgatcgagaacacctccacacagaggctgcttaacgcccagaaggccttcaccggcatcgaggaccccgtcaccaagaagaggctctcggtgggcgaggccgtccagaagggctggatgccccgggagagcgtgctcccacacctgcaggtgcagcacctgaccggggggctcatcgaccccaagaggacaggccgcatccccatccagcaggccctcctctccgggatgatcagtgaagagctggcccagctcctgcaggacgagtccagctacgagaaggatttgacagaccccatctccaaggaacggctgagctacaaggaggccatgggccgctgccgcaaagaccccctgagcggcctgctgctcctgccagcggcactggaggggtaccgctgctaccgctccgcctcccccaccgtcccgcgctcccttcgctgacacgggccaaggagccagtggg

SEQ ID NO: 130023 - DNA, 585 bp, Homo sapiens
  Payload ID: 5433
  Gene Symbol: EVPL
  Gene Name: envoplakin
  ENST ID: ENST00000589231
  CDS Start-End: 1-339
cagaagggctggatgccccgggagagcgtgctcccacacctgcaggtgcagcacctgaccggggggctcatcgaccccaagaggacaggccgcatccccatccagcaggccctcctctccgggatgatcagtgaagagctggcccagctcctgcaggacgagtccagctacgagaaggatttgacagaccccatctccaaggaacggctgagctacaaggaggccatgggccgctgccgcaaagaccccctgagcggcctgctgctcctgccagcggcactggaggggtaccgctgctaccgctccgcctcccccaccgtcccgcgctcccttcgctgacacgggccaaggagccagtggggaagtgcgtgtgttgggccagattaaggagagaaatgtggctccaagactttgtgggcaagaatggacagtggacgggcgcagtggctcacacctgtgatccccccagcactttgagaggccaaggtaggaggatcgcttgagcccaggagttcgagaccagtctgagcaacatagtgagaccccatttctacaaaaataaaattagctgggcatggtggtgca

SEQ ID NO: 130024 - DNA, 2095 bp, Homo sapiens
  Payload ID: 5434
  Gene Symbol: EVPLL
  Gene Name: envoplakin-like
  Uniprot ID: A8MZ36
  ENST ID: ENST00000399134
  CDS Start-End: 359-1264
agtgtggtttttgtgggtgcatgcgcggcaggcctggggcctggccgcctgctgcctcacctgcaaggaggggcctcccagaaactcccttccccaatgcccagccgccccaccttgccagacttagctgaccagccagcaaggacgcccgctgcctcccacctgccctcctgccctccttcaccagccaagcccagcctgagccagcacctgcctttatgaccatgttcaagggactgagcaaaggctcccaggggaaggggtcccccaaggactccccagccaaggggtcccccaaaggctcccccagcaagcacagctgaatgccacccaggagctgaccctgctcatctcccacatgcaagccagcgccgaccaggtggagcgggacatcctggagacgcagaagaggctgcagcaggaccggctgaacagtgagcagagccaggccctgcagcaccagcaggagacgggcagcagcctgaaggaggccgaggtgctgctcaaggacctcttcctggacgtggacaaggcccggcggctcaagcacccgcaggctgaggagactgagaaggacatcgagcagctgcacgagcgggtgacccaggagtgtgcggagtactgtgccctgtacgagaagatggtgctgccgccccgacgtgggatccaaggtcgactgggcacacgtgctggagcagaaacagaagctggtctgcgcaggccagtatgggccgggcatggcggagctggaggaacagatcgcggagctcaacatcgtgcagaaggagatcaacgaccaaggagagcagctgcggagcctggtggggccggatgccgccaccatccggagccaataccgagacctactgagggcggcgtcgtggcgcgggcagagcctgggcagcctgtacacgcactgcagggctgcacgtggcagctgagcgccctggcggagcagcagcgccgcatcctgcagcaggactggagcgacctcatggccgaccctgcgggcgtgcggcgggaatacgagcacttcaagcagcacgagctgctgagccaggagcagagcgtaaaccagctggaggaggacggcaagcgcatggtggagctgcggcaccccgcggtggggcccatccaggcccaccaggaggccctgaagatggagtggcagaacttcctgaacctgtgcatctgccaggagacccagctccagcacgtggaggactacagccggattctgtgtccatcttcctctcctcattgactctgcatgaaggggatttctggtggagtaagggtagcagctcttgccgcacgtgcagagagagaggaacttccagtgcccgctatggagccacagcccacagcatggggaagtccccatccagaggcagtgctgcagctagaggtagctccagagtcctccgggccctgcaccgatacagccaaagaccagcaaagcgacaagctgccagacctcatgccacctgctgtagccactgggctcagccctggagctgagagcatcgctggagatagacgtggcagagaagaggttgcgagcatggccccagccagcagctcccacgctgcccctagtcctgggcatggagcgagccttggtgtcagagaccagggtgtgcagtctgagctcctctaccttactaaagagaggcctcttttatttaccagagccacagccctgctgcctcaggaccttttcattctgccggtgctggggctgtctatctgcaagctggaggtgttgagagcaggaaaaggaggctgtgaggaagggttcgggcagctcctcctgctctcagaggtggcctcctcctccaggcatggaggtctgtccactactgggcttctgggctatttgcccctgatttgctccctggtacgggctcttcttaacaggcaggcaaggggtgcggggaccaggtgagggcttcaaagggtacagtaccaaatcttccaaactcagcacttgtgccctggggtctccaaactgtcttctgccctagaatttattcatactgttaaattaccagtttatgcaaatgatatgtaaataaagctcaattttttgaaa

SEQ ID NO: 130025 - DNA, 3386 bp, Homo sapiens
  Payload ID: 5435
  Gene Symbol: EOMES
  Gene Name: eomesodermin
  Uniprot ID: O95936
  ENST ID: ENST00000295743
  CDS Start-End: 205-2265
tttccttccggaaaggacgctggattcagggcgcgccagtacgcgcagtagcggcccgcgagtcggcaggtgggtagccccggcgcgggaggaaggggaagttaccttcccctcggaagagggcgctggctcccccatcctgcctttataataaggccaccggaggagaggaagcagccagctgccgtctgcgctttgcaaagcatgcagttaggggagcagctcttggtgagctcagtgaacctgcctggcgcgcacttctacccgctggagagtgcgcgaggcggcagcggcgggagcgctggccacctccccagcgcggccccctctcctcagaagttggacttagacaaagcgtccaagaagttttccggcagtctctcctgcgaggcggtgagcggggagcccgcagccgccagcgcaggggcccccgcggccatgcttagtgacaccgacgccggggacgcatttgccagcgctgcggcagtggccaagccggggcccccggacggccgcaagggctccccctgcggggaggaggagctgccctccgccgctgcagccgccgccgccgccgccgccgcggctgcggccactgcgcgctactccatggacagcctgagctccgagcggtactacctccagtcccccggtcctcaggggtcggagctggctgcgccctgctcactcttcccgtaccaggcggcggctggggcgccccacggacctgtgtacccggctcctaacggggcgcgctacccctacggctccatgctgccccccggcggcttccccgcggctgtgtgcccacccgggagggcgcagttcggcccaggagccggtgcgggcagtggcgcgggcggtagcagcggcgggggcggcggcccgggcacctatcagtacagccagggggctccgctctacgggccgtaccctggagccgcagcggcgggatcttgcggaggactggggggcctgggggttccaggttctggcttccgtgcccacgtctacctgtgcaaccggcctctgtggctcaaattccaccgccaccaaactgagatgatcattacgaaacagggcaggcgcatgtttcctttcttgagcttcaacataaacggactcaatcccactgcccactacaatgtgttcgtagaggtggtgctggcggaccccaaccactggcgcttccaggggggcaaatgggtgacctgtggcaaagccgacaataacatgcagggcaacaaaatgtatgttcacccagagtctcctaatactggttcccactggatgagacaggagatttcattcgggaaattaaaactcaccaataacaaaggcgcaaataacaacaacacccagatgatagtcttacaatccttacacaaataccaaccccgactgcatattgttgaagttacagaggatggcgtggaggacttgaatgagccctcaaagacccagacttttaccttctcagaaacgcaattcattgcagtgactgcctaccaaaacaccgatattactcaactaaagattgatcataacccctttgcaaaaggcttcagagacaactatgattcatcccatcagattgtccctggaggtcggtacggcgttcaatccttcttcccggagccctttgtcaacactttacctcaagcccgctattataatggcgagagaaccgtgccacagaccaacggcctcctttcaccccaacagagcgaagaggtggccaaccctccccagcggtggcttgtcacgcctgtccagcaacctgggaccaacaaactagacatcagttcctatgaatctgaatatacttctagcacattgctcccatatggcattaaatccttgccccttcagacatcccatgccctggggtattacccagacccaacctttcctgcaatggcagggtggggaggtcgaggttcttaccagaggaagatggcagctggactaccatggacctccagaacaagccccactgtgttctctgaagatcagctctccaaggagaaagtgaaagaggaaattggctcttcttggatagagacacccccttccatcaaatctctagattccaatgattcaggagtatacaccagtgcttgtaagcgaaggcggctgtctcctagcaactccagtaatgaaaattcaccctccataaagtgtgaggacattaatgctgaagagtatagtaaagacacctcaaaaggcatgggagggtattatgctttttacacaactccctaaagagttattttaacctcaaaaattagctaactttttgcagatggacttggtggtgttttttgttgtcttctttgcctaggttgccaaaaagatgtttgccttccaccttgatgcatcctgttttgtgcaattctctaaaagaaggtgccaaagctttttgattgctgcaggtaactgaaacaaacctagcatttttaaaaaataagattaatggaagactttaaggtattttaaaattcgaagggtatccaaggttctgtatttatttattggggagacactaacccttcaaagaagcaggctgtgaacattgggtgcccagtgctatcagatgagttaaaacctttgattctcatttctatttgtaaattcttaagcaaatagaagccgagtgttaaggtgttttgcttctgaaagagggctgtgccttccgtttcagaaggagacattttgctgttacattctgccaggggcaaaagatactaggcccaggagtcaagaaaagcttttgtgaaagtgatagtttcacctgactttgattccttaacccccggcttttggaacaagccatgtttgccctagtccaggattgcctcacttgagacttgctaggcctctgctgtgtgctggggtggccagtgggactcaggagagagcaagctaaggagtcaccaaaaaaaaaaaaaaaaaaaagggagaatttaaaagtgtacagttgtgtgtttagatacactatagaataatgtggtatatattgtacaaatagtctacataggtgtctgggataatgtaaaactggtgctttggctttgtaaagaatttgcaaatcacttaacagctgcaggggcaaggggagagtttcatcatccccatgatatttgggaatattctgtttacttcttagatagttaagaatgtattcagctactatgtactaacttgaaccgtgtttaaggaaaactcctatttcatcctcttcttgcgccatcccctctccctaacttggtaatgtgaagaaactaaaacctgataccacagctcctataggcattttagagatcttggatttttatgtacagtcttagtcatttttaataaatgtggttcagtaagggaacgga

SEQ ID NO: 130026 - DNA, 2829 bp, Homo sapiens
  Payload ID: 5435
  Gene Symbol: EOMES
  Gene Name: eomesodermin
  Uniprot ID: O95936
  ENST ID: ENST00000449599
  CDS Start-End: 19-2136
gtctgcgctttgcaaagcatgcagttaggggagcagctcttggtgagctcagtgaacctgcctggcgcgcacttctacccgctggagagtgcgcgaggcggcagcggcgggagcgctggccacctccccagcgcggccccctctcctcagaagttggacttagacaaagcgtccaagaagttttccggcagtctctcctgcgaggcggtgagcggggagcccgcagccgccagcgcaggggcccccgcggccatgcttagtgacaccgacgccggggacgcatttgccagcgctgcggcagtggccaagccggggcccccggacggccgcaagggctccccctgcggggaggaggagctgccctccgccgctgcagccgccgccgccgccgccgccgcggctgcggccactgcgcgctactccatggacagcctgagctccgagcggtactacctccagtcccccggtcctcaggggtcggagctggctgcgccctgctcactcttcccgtaccaggcggcggctggggcgccccacggacctgtgtacccggctcctaacggggcgcgctacccctacggctccatgctgccccccggcggcttccccgcggctgtgtgcccacccgggagggcgcagttcggcccaggagccggtgcgggcagtggcgcgggcggtagcagcggcgggggcggcggcccgggcacctatcagtacagccagggggctccgctctacgggccgtaccctggagccgcagcggcgggatcttgcggaggactggggggcctgggggttccaggttctggcttccgtgcccacgtctacctgtgcaaccggcctctgtggctcaaattccaccgccaccaaactgagatgatcattacgaaacagggcaggcgcatgtttcctttcttgagcttcaacataaacggactcaatcccactgcccactacaatgtgttcgtagaggtggtgctggcggaccccaaccactggcgcttccaggggggcaaatgggtgacctgtggcaaagccgacaataacatgcagggcaacaaaatgtatgttcacccagagtctcctaatactggttcccactggatgagacaggagatttcattcgggaaattaaaactcaccaataacaaaggcgcaaataacaacaacacccagatgatagtcttacaatccttacacaaataccaaccccgactgcatattgttgaagttacagaggatggcgtggaggacttgaatgagccctcaaagacccagacttttaccttctcagaaacgcaattcattgcagtgactgcctaccaaaacaccgatattactcaactaaagattgatcataacccctttgcaaaaggcttcagagacaactatgattccatgtacaccgcttcagaaaatgacaggttaactccatctcccacggattctcctagatcccatcagattgtccctggaggtcggtacggcgttcaatccttcttcccggagccctttgtcaacactttacctcaagcccgctattataatggcgagagaaccgtgccacagaccaacggcctcctttcaccccaacagagcgaagaggtggccaaccctccccagcggtggcttgtcacgcctgtccagcaacctgggaccaacaaactagacatcagttcctatgaatctgaatatacttctagcacattgctcccatatggcattaaatccttgccccttcagacatcccatgccctggggtattacccagacccaacctttcctgcaatggcagggtggggaggtcgaggttcttaccagaggaagatggcagctggactaccatggacctccagaacaagccccactgtgttctctgaagatcagctctccaaggagaaagtgaaagaggaaattggctcttcttggatagagacacccccttccatcaaatctctagattccaatgattcaggagtatacaccagtgcttgtaagcgaaggcggctgtctcctagcaactccagtaatgaaaattcaccctccataaagtgtgaggacattaatgctgaagagtatagtaaagacacctcaaaaggcatgggagggtattatgctttttacacaactccctaaagagttattttaacctcaaaaattagctaactttttgcagatggacttggtggtgttttttgttgtcttctttgcctaggttgccaaaaagatgtttgccttccaccttgatgcatcctgttttgtgcaattctctaaaagaaggtgccaaagctttttgattgctgcaggtaactgaaacaaacctagcatttttaaaaaataagattaatggaagactttaaggtattttaaaattcgaagggtatccaaggttctgtatttatttattggggagacactaacccttcaaagaagcaggctgtgaacattgggtgcccagtgctatcagatgagttaaaacctttgattctcatttctatttgtaaattcttaagcaaatagaagccgagtgttaaggtgttttgcttctgaaagagggctgtgccttccgtttcagaaggagacattttgctgttacattctgccaggggcaaaagatactaggcccaggagtcaagaaaagcttttgtgaaagtgatagtttcacctgactttgattccttaacccccggcttttggaacaagccatgtttgccctagtccaggattgcctcacttgagacttgctaggcctctgctgtgtgctggggtggccagtgggactcaggagagagcaagctaaggagtcaccaaaaaaaaaaaaaaaaaaaa

SEQ ID NO: 130027 - DNA, 2080 bp, Homo sapiens
  Payload ID: 5435
  Gene Symbol: EOMES
  Gene Name: eomesodermin
  Uniprot ID: O95936
  ENST ID: ENST00000461503
  CDS Start-End: 287-1519
ttccaagtggtcaacttgaccgatgctttggcaattgaaaaagggcagaaaggcgcgggctagtgggtggatggggacaaagatctaagtcaccttcttccagcgtgtgagcctgggaggagggtgggggtcctgaggagcaagaggtacgaggaaggaaaaggagagggcttctgggttagtttccacctcctgctttccaactcacggcgctttccttccggaaaggacgctggattcagggcgcgccagtacgcgcagtagcggcccgcgagtcggcaggcgcatgtttcctttcttgagcttcaacataaacggactcaatcccactgcccactacaatgtgttcgtagaggtggtgctggcggaccccaaccactggcgcttccaggggggcaaatgggtgacctgtggcaaagccgacaataacatgcagggcaacaaaatgtatgttcacccagagtctcctaatactggttcccactggatgagacaggagatttcattcgggaaattaaaactcaccaataacaaaggcgcaaataacaacaacacccagatgatagtcttacaatccttacacaaataccaaccccgactgcatattgttgaagttacagaggatggcgtggaggacttgaatgagccctcaaagacccagacttttaccttctcagaaacgcaattcattgcagtgactgcctaccaaaacaccgatattactcaactaaagattgatcataacccctttgcaaaaggcttcagagacaactatgattccatgtacaccgcttcagaaaatgacaggttaactccatctcccacggattctcctagatcccatcagattgtccctggaggtcggtacggcgttcaatccttcttcccggagccctttgtcaacactttacctcaagcccgctattataatggcgagagaaccgtgccacagaccaacggcctcctttcaccccaacagagcgaagaggtggccaaccctccccagcggtggcttgtcacgcctgtccagcaacctgggaccaacaaactagacatcagttcctatgaatctgaatatacttctagcacattgctcccatatggcattaaatccttgccccttcagacatcccatgccctggggtattacccagacccaacctttcctgcaatggcagggtggggaggtcgaggttcttaccagaggaagatggcagctggactaccatggacctccagaacaagccccactgtgttctctgaagatcagctctccaaggagaaagtgaaagaggaaattggctcttcttggatagagacacccccttccatcaaatctctagattccaatgattcaggagtatacaccagtgcttgtaagcgaaggcggctgtctcctagcaactccagtaatgaaaattcaccctccataaagtgtgaggacattaatgctgaagagtatagtaaagacacctcaaaaggcatgggagggtattatgctttttacacaactccctaaagagttattttaacctcaaaaattagctaactttttgcagatggacttggtggtgttttttgttgtcttctttgcctaggttgccaaaaagatgtttgccttccaccttgatgcatcctgttttgtgcaattctctaaaagaaggtgccaaagctttttgattgctgcaggtaactgaaacaaacctagcatttttaaaaaataagattaatggaagactttaaggtattttaaaattcgaagggtatccaaggttctgtatttatttattggggagacactaacccttcaaagaagcaggctgtgaacattgggtgcccagtgctatcagatgagttaaaacctttgattctcatttctatttgtaaattcttaagcaaatagaagccgagtgttaaggtgttttgcttctgaaagagggctgtgccttccgtttcagaaggagacattttgctgttacattctgccaggggcaaaagatactaggcccaggagtcaagaaaagcttttgtgaaagtgatagtttcacctgactttgattccttaacccccggcttttgg

SEQ ID NO: 130028 - DNA, 2708 bp, Homo sapiens
  Payload ID: 5436
  Gene Symbol: EPX
  Gene Name: eosinophil peroxidase
  Uniprot ID: P11678
  ENST ID: ENST00000225371
  CDS Start-End: 111-2258
ggaagtgagaggtcggctgggggtcctcaaagtgagaggggagcagaggatcctcccgtgcaggctgtggatgtcactcacttcccagctggtgaagcctcgctgcagagatgcatctgctcccagccctggcaggggtcctggccacactcgtcctcgcccagccctgtgagggcactgacccagcctcccctggggcagtggagacctcggtcctgcgagactgcatagcagaggccaagttgctggtggatgctgcctacaattggacccagaagagcatcaagcagcggcttcgcagcggttcagccagccccatggacctcctgtcctacttcaaacaaccggtagcagccaccaggacagttgttcgggccgcagattatatgcatgtggctttggggctgcttgaagagaagttacaaccccagcggtccggacccttcaatgtcactgatgtgctaacagaaccacagctgcggctgctgtcccaggccagtggctgtgctctccgggaccaggccgagcgctgcagcgacaagtaccgcaccatcactggacggtgcaacaacaagaggagacccttgctaggggcctccaaccaggctctggctcgctggctgcccgccgagtatgaggatgggctgtcgctccccttcggctggacccccagcaggaggcgcaatggcttccttctccctcttgtccgggctgtctccaaccagattgtgcgcttccccaatgagagactgacctccgaccgtggccgagccctcatgttcatgcagtggggccagttcattgaccatgacctggacttctccccggagtccccggccagagtggccttcactgcaggcgttgactgtgagaggacctgcgcccagctgcccccctgctttcccatcaagatcccacccaatgacccccgcatcaagaaccagcgtgactgcatccctttcttccgctcggcaccctcatgcccccaaaacaagaacagagtccgcaaccagatcaacgcgctcacctcctttgtggacgccagcatggtgtatggcagtgaggtctccctctcgctgcggctccgcaaccggaccaactacctggggctgctggccatcaaccagcgctttcaagacaacggccgggccctgctgcccttcgacaacctgcacgatgacccctgtctcctcaccaaccgctcggcgcgcatcccctgcttcctggcaggtgacacccgatcaacggaaacccccaaactggcagccatgcacaccctctttatgcgagagcacaaccggctggccaccgagctgagacgcctgaatccccggtggaatggagacaaactgtacaatgaggctcggaagatcatgggggccatggtccagatcatcacctaccgagactttctgcccctggttctgggcaaggcccgggccaggagaaccctggggcactacagggggtactgctccaatgtggacccacgggtggccaatgtcttcaccctggccttccgctttggccacacaatgctccagcccttcatgttccgcttggacagtcagtaccgggcctccgcacccaactcgcatgtcccacttagctctgccttctttgccagctggcggatcgtgtatgaagggggcatcgaccccatcctccggggcctcatggccacccctgccaagctgaaccgtcaggatgccatgttagtggatgagctccgggaccggctgtttcggcaagtgaggaggattgggctggacctggcagctctcaacatgcaacgaagccgggaccacggccttccagggtacaatgcttggaggcgcttctgtgggctctcccagccccggaatttggcacagcttagccgggtgctgaaaaaccaggacttggcaaggaagttcctgaatttgtatggaacacctgacaacattgacatctggattggggccatcgctgagcctcttttgccgggggctcgagtggggcctcttctggcttgtctgttcgagaaccagttcagaagagcccgagacggagacaggttctggtggcagaaacgaggtgttttcaccaaaagacagcgcaaggccctgagcagaatttccttgtctcgaattatatgtgacaataccggtatcaccacggtttcaagggacatcttcagagccaacatctaccctcggggctttgtgaactgcagccgtatccccaggttgaacctatcagcctggcgagggacatgaggcttctgcaggagtctatcccaagtctccaacttttggagacaaggggaaggggaggaccatgaggctgccttgtctccctggagcaagtgcaggctgctgacgcttctgctggctacagctcagagctgggttccccagccaggagtgaaggctgggggctcctatcagcaatggaccttcccgccttgggagcctcttaggtattaggctatgaatcagcgccacgtgcaaaggcttgggagccaagccatgtggtcttgcaccccaggcaagaaaagtcagctggagggtttacagcactttctactgtttcccagccctccctcccctccctcaccatgactaagagaccactcggtcctagcctccagacaccccacaatactcctctgagcctgaggccaggcagcatgctctgcttctaccaataaagcactgctaagggca

SEQ ID NO: 130029 - DNA, 2298 bp, Homo sapiens
  Payload ID: 5437
  Gene Symbol: EID1
  Gene Name: EP300 interacting inhibitor of differentiation 1
  Uniprot ID: Q9Y6B2
  ENST ID: ENST00000530028
  CDS Start-End: 292-855
agcagcagtagggttaagtaacacagaaactgttacgctcttgcatgcagggtccctagatacgaagttcgaatcgatggaaacgtagctcaaaaggcgacgccaacaccccggagaaaacactgagctactccaaccacagtggcgcgccaagtaggaggcggtacctgaggaccacgcctgcgcgcggggttacgcaagcgcgcagcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgtattttgtttggctaatagtattgcatacatactttctctgtatactactttctattgtatgtgttaaccagtattaagggaaaatgatccagcttcagctatctaattcacaaattaatttctggaaattaaactttgtaaattaagtttttgcctataagaatttgctggtctgggaaaacctgccctatcaatgagtatgttgccgtggttaccttactaagatgctgaagttctaggagagtaatgattacatcagaaggctaggttcagcaaaataagtgtatcagcaggttttatcatgatcagtaaaaatgttccaaatgcttctgctccattatagcagtaaagaacgaatatccaatgcaacaggacaatt

SEQ ID NO: 130030 - DNA, 584 bp, Homo sapiens
  Payload ID: 5437
  Gene Symbol: EID1
  Gene Name: EP300 interacting inhibitor of differentiation 1
  ENST ID: ENST00000560490
  CDS Start-End: 42-539
cttgctggaagctttttcctagaggttgagcggtttgcacaatgtcggaaatggctgagttgtccgagctgtatgaagagagcagtgacctgcagatggatgtgatgcctggcgagggtgaccttccgcagatggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggaccca

SEQ ID NO: 130031 - DNA, 1981 bp, Homo sapiens
  Payload ID: 5438
  Gene Symbol: EID2
  Gene Name: EP300 interacting inhibitor of differentiation 2
  Uniprot ID: Q8N6I1
  ENST ID: ENST00000390658
  CDS Start-End: 152-862
gtaagaatctatgctctcgcgcccggttacgcacactgcatttacagcgcgcatagcgcccacgcacgcgcactggggtgtccgccgggcatcgctctgtccagttattccagtttctctgggagcagccgagttgaccccacggtctgagatgtccaagctgcccgcagacagcagtgtcccgcagacaggcgcggcgaatggtgacagagacgtcccgcaggcggaggtaggccgcgggaggcgggagccggccccggcacagcctgaggaggccggggaaggcgcgatggcggcggccaggggaggcccggtgccggcggccagggaaggtcggatggcggcggccagggcagccccggcggcggcagccaggggagccccggtggcagcggcggcgttggccagggcagccgcggcgggcagggaaagcccggcggcggcggcggccagggaagcccggatggcggaggtcgcccgcttgctgggggagccagtggacgaagagggtcccgagggcaggcccaggtccagacacgggaacggaggcctggctgcgttgccctatctccgtctccgccacccacttagcgttttaggcatcaattaccagcagtttctccgccactatctggaaaattacccgattgctcccggcagaatacaagagcttgaagaacgccgcaggcgattcgtggaagcctgcagagcaagggaagcagcgtttgatgccgaatatcagcgaaatcctcacagggtggacctcgatattttaacctttacgatagctctgactgcctctgaagttatcaaccctctgatagaagaacttggttgcgataagtttatcaatagagaatagttatgtggtgacactacttcaagagaacctctgcattccagtcataccaatcctgcaacttgattttcagaagtcaagagtatatcgcgataagacagtgcacaggtggaggggaaaaaaagggggagggggaagcttatcttgaaaaagcatcacagaagtagaaaaaaatgtcgaaagcattataactgtaacgttctttgagtttgtgattgatccacatttttccccctgcattatggaaaatgtctctcagcattgctttattacaaagtaaaggatggttttataaaattgagactgatgaaacatcaatactagagcccatgaggatgaaagaaattatcaaatagtgctgaacagaataagatgttaacgctgagttattaggactggaaggctatgaaaagaacttgaaattgtcggaatatgtgctctcttcatgtcatattcaatagaagtttctagtttaagattgattttgtgttttcttaggcatttcaagtgacaagcaaagtaaatgtatatattatgtgataaatcatgttttcaagaacgtcaaatttctggacttttttctttcaatttttaatttttaaagtttttttggtattaaaaaatctattcacaagccaaaaaatatataaaatatacagcgaaaagccttccattcttgttttcctccatccagtaccaacgatgacctctaatagccacagtttcctttccgtccttctagtttccttacgtgtacacaggcacatataaatctgggtttacttgttttatttcttcacagaagtcggcatattatatttactggtttatacattgctttctcattaagaacatatgttgacccttccaaaccactgtatttcctcattattttttaaagtggcattttattccattctgaggttatgtccaaatttacttaaccagggatatattgacggacatttaggttgtttcccatctctttctttgggcagaataaaaaattgctagagtagttcatcttgtacaattgctagagtagttcatcttgtatatcatgtggcatgtgcacaaatatagtattgcttcaattcaaaattcacttcatatttgaacatc

SEQ ID NO: 130032 - DNA, 1865 bp, Homo sapiens
  Payload ID: 5439
  Gene Symbol: EID2B
  Gene Name: EP300 interacting inhibitor of differentiation 2B
  Uniprot ID: Q96D98
  ENST ID: ENST00000326282
  CDS Start-End: 53-538
gcatacagcagtgcagtgccgttattccagtctccgtagaaacgctgggactatggcggagccgactgggctgttggagatgtccgagctccccggagatagcagtgtcccacaggtgggcaccgcgagtggcgtcagcgacgtactgcggggggcagtcggcggcggggttcgggtgcaggaggctcgggaaggcccagtggccgaagctgcgcggtccatggcgcggatgccgggccctgtgcccgggcccatccccagcagcgtcccgggcctggcctccgcgccagacccccatcagcagctcgctttcttagaaattaaccggcagctgttgttccgcgagtatctggatggtagctccatgattccggtcagattactacgggatttcgaggaacgccgcaggctgtttgtggaaggctgcaaggcgagggaagcagcctttgacgcggatcccccgcagatggacttcgctgctgtcgcgtttacggtagcgctgactgcctccgaggccctcagtcctctggccgactgagtcggctgtgatgatgacattggtggcaaggaatagccaagtgacccttttgggatcaaaagaacaggcaggctgtgccagtttagttaactcagtcattagggggaatgcaaactggaagggaatacggcaatgtgcaattgaaggaggaagcacactccgaaatggaaacagacaagactgttgaatcttgttttctttcttcttttttagtattatttaaatagagaagggagtctcgcatccctaggctggtcccgaacgcttggacccgagcgatcctcccgcttcggcctcccaaagtgctgggattactttacaggcgtgagccaccgcgcccggccgaatcttgttttcaaacaggtcccaagacacttctgacttagcactttgttagcaatgcattttcctgcatttgtgaagaatccttcatgactttcaccataaaggatggttttgcaaagatatgagaaaaaaaaaatgccaataacagaacccatagaaatgaacctaagtgatgaaagaaaacaaagaaatagagttgtcaggaatccaggtgtacctgagttactaggattggaaggctattgagaggactttgaaatttcacaatttgtggtcatgtcaacaaatcctagtgtaagattcatatttgtgttttctgaggtactttagatgaacagtaaatattcaatagaaaaaaccacgtattatatgatcagtgttttcaagtctatgtgaaattgggtaggtgtggaataaacttgttttttgttaattttaagctttttattttattctagaatatgtattctattcacaagactcaacaaaaaaaagtatcggccgggcgcactggcttacgcctgtaatcccagcactttgggaggccacggcgggtggatcacctgaggtcaggaattcaagaccaccctggccaacatggtgaaaccccatctctacgaaaaataaaaaattaactgggtgtggtggcacgcgcttgtagtcccagctactcgggaggctgaggcaggagaatcacttgaacctgggaggcggaggttgcagtaagccgagatcacgccactgcactccagcctggtcaacagagtgggactccgtctcaaaaaaaagaaaaaaagtatcaaaagatgctgtgagaaatctctcttgttgctgtcctttgccaaactcagaactattccatgcaggtgccattgcttgtggcttggagttttgttgttgttttcttggttttgcttgttttttgctttttcactgtacgcctttcaggttttctaatgcatatgcaaataaacatcaatct

SEQ ID NO: 130033 - DNA, 1464 bp, Homo sapiens
  Payload ID: 5440
  Gene Symbol: EID3
  Gene Name: EP300 interacting inhibitor of differentiation 3
  Uniprot ID: Q8N140
  ENST ID: ENST00000527879
  CDS Start-End: 197-1198
atgggcgggcgtcctcggctctaactgccgccactttccacacgctgggagggccgttacctcagagatacccgtggccggcatgttggttgaaaaagcttcccggaagggagacgaagagaaaggagaggagcagctcgtgatcatccccggtagcgagtacgcggcgaagtaggcggcggcggagggagcgctgatgaagatggatgtgtcagtgagggccgcgggctgctccgacgacctcagctctggggaggccgacgtagacccaaagctcctggagctcaccgctgacgaggagaagtgccgcagcatccgcaggcagtaccggcagctcatgtactgcgtgcggcagaaccgggaggacatcgtgagctcggcgaacaactccttaaccgaggctctggaggaagccaacgtcctctttgatggcgtgagccgaaccagagaagcagccctcgacgcccggtttcttgttatggcttctgatttgggtaaagaaaaggcaaagcagttaaactcagatatgaacttctttaatcagttagcattttgtgactttctgtttctgttcgtgggtctgaattggatggaaggcgatcctgacaagttgagtgattgtgatgatagcatagctctttccttctggaaggcaatagaaaaggaagcaacatcctggatggtaaaagctgagacattccattttgtttttggttcattcaagctagaacgttctgcaccaaagccccgacttgaacaccagaaaaaagttcgcaagatggaagaaaatggcaacatgcctacaaagttgcagaagttggacctgagtagttatccagaagcgacagaaaaaaacgtagaaaggattttgggattgttgcaaacctactttcgaaagtatcctgatactcctgtgtcctattttgagtttgtgattgatccaaactctttttctcgtactgtggagaatatattttatgtttcttttattgtaagagatggttttgcaagaataaggcttgatgaagacaggctgccaatattagagccgatgaatgttaaccaaatgggtgagggaaatgattccagttgccatggcaggaaacagggagttatatctttgactttacaggagtggaaaaacattgtggcagcttttgaaatttctgaggctatgattacatactcctcatactaaagatttcttagtatagcatcctttttgtgttttttttctgaagttagatggagagtaaaatgtaaactgaagcacatattgtatctcttgtaaagtgaaaaagtattttcaagaacatcagacattgttttactgtgcagcatatttttcttagtaatttataaggtcatgatcttctgttattaaaacaaattcactggcatatttatgggaacgttttattgaatgccctttaagactattaataaaaacaagttttggatacc

SEQ ID NO: 130034 - DNA, 2741 bp, Homo sapiens
  Payload ID: 5441
  Gene Symbol: EP400NL
  Gene Name: EP400 N-terminal like
  Uniprot ID: Q6ZTU2
  ENST ID: ENST00000332441
  CDS Start-End: 318-1610
tttaagctaatttttttcttatttctaaagcaaaacaaaacccaaactcattgtaatcctctttggaattgcattacatgtatatgttcagttgtgaaggcatgacattttatgatagtaaatcttattctggaacatggtatgttgcttcattttattcgtgtttttttgagacggagttttgcttttattgcccaggctggagtgtagtggcgcaatcttggatcaccacaacctccgtctcccaggttcaagcgattctcccgcctcagcctcctgagtagcaattacagggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatgcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcatcaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgaggacttctgcggcttttccagcccagcagcagccgctccagcccctggcacccaccactgtactgtctgtctctgcggattggaatgcacttctccagcgacctaacaaatacatatggggactccagtacctggagatgtgaattccataaaaatggaagcatctaagaggcagtgaacactggcgcccacaggagaaccaggtgcatcagcgcattgcggagctgaggaaagcaggtctgtggtcccagaggcgtctgctgaagctgcaggaggcccacgacccaagtcccactgggactatctgctggaggagatgcagtggatggccacagactttgcccaggagaggtggaaggtggcctctgtgaagaagatggtcagagctgtggcccggcagctgcaggacaggacgcgcagggaggccggggccaggagggaggagccgagcaggctgaggcagacgtcacctgtactaccagagaaatcgagcgtccctggtctagtactgcgcaggtaaagattccagcatcttggaagcaagtgctccactggaaaataaaagccacgtggagcacttgattagactccagaaacagaaactgcagctgctcccaccacccccaccaccacaggccctgcccggggcacagccaaccacacaagtgcaagtgcagccgtcacccgcctaccacagcagagcccccagctcaccacagtcacggccccgagacccagagccctgttgatgggcaccaccatggccaacctccaggtagcccggcttactcgagtttccacctcccacctgcaaggcccaagactgacgtcagcgctgacgtaccagatggcccaggttgctgtggccacgccccctgtggtgtctgtcctggcagttgtggtgctgtcagccagggtcacagtgcttccatcaacgcaacgggatcagtgttgtgataaggcagctgcaaaaagcggcaggtaggcagccaccttcgcctcaccaaactcgaaacaactcacttgagtgagttgcatcaaacctttctaaatttctcattctagaagttgctgagttgttctgccatgtgttaacttttttttcttatcagtaaaatcttttatttggtttatatttcaaatgtaatttaaaaagtctataagacaggaaattcgataatatgaaagcagggagaaactaagtcgcaccatttagctaagctcagggacaacgttcatttataataaatcaaacatttgatttttttcatgcc

SEQ ID NO: 130035 - DNA, 1726 bp, Homo sapiens
  Payload ID: 5441
  Gene Symbol: EP400NL
  Gene Name: EP400 N-terminal like
  ENST ID: ENST00000389560
  CDS Start-End: 322-1581
gtagtggcctcgccgcccggtccgctgtcgcagcgctcatccgcgccgggagcccttggctgcgtcgcccggcagccgcggctggagtgtagtggcgcaatcttggatcaccacaacctccgtctcccaggttcaagcgattctcccgcctcagcctcctgagtagcaattacaggccgagtctcactctgtcgcccaggatggagtgcagtggcgcaatgtcggcttactgcaacctctgcctcccaggttcaagcgattctcctgcctcagcctccagagtacctgggattacagggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcatcaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggctcttagttttaatgcatggatgctgttatttttccctactgttactgaaattaaaaagtgtttgtctctga

SEQ ID NO: 130036 - DNA, 2172 bp, Homo sapiens
  Payload ID: 5441
  Gene Symbol: EP400NL
  Gene Name: EP400 N-terminal like
  Uniprot ID: Q6ZTU2
  ENST ID: ENST00000392352
  CDS Start-End: 957-2027
acatccgccggttaccctcgaggctccccggccgcgcgctcccctctctccgtcccatcacccggtgaccccggctgagcgaacgcccacccctccctcagggaccccctccccgtgacacgatcccccgtgaacgcccacctccctcagtgaacactcccccgtgacatgaccccccgcaaacgcccacccatccctcggtgaccctgcgcccgtgagcgcccacccctccccctgcgacccctccccccgccacctggcaactgccgttttcccgccttccctcctccgccccctctcccgcatcaccccgttttctggtgaccgctcccccccatcccgtgacacaaacccccgacctcccagcccttccccggtgacacgatccctgtgaccgtctggcccggtaaccgcccctcccctcatgacccttcacccagtcccctggtgcccacccccgtcactgccgcccgcctggttccagcctcgcgagaccgctgtctacggcgctgacgccgcctctgcctcttgaccccttggccccgctgtcctgatccctgaggtcggggcctggtctgcactccaggaaagacgagtgcgcttagtgtgcgctgcacgtgagcagtgaagttgattccacgcgctgcgctgctcggcagctgtcccagaactgaccacggacccctccgcgggtcctgctcctgacaagggccttccggcactgggagttttgtgttagtggaaaggaagaatctaataataccaccacctttacagtaaagacgctgcgaattgacgccttttataataaagacacttatcttgcccaagagctgggctggagtgtagtggcgcaatcttggatcaccacaacctccgtctcccaggttcaagcgattctcccgcctcagcctcctgagtagcaattacagggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcatcaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggctcttagttttaatgcatggatgctgttatttttccctactgttactgaaattaaaaagtgtttgtctctga

SEQ ID NO: 130037 - DNA, 945 bp, Homo sapiens
  Payload ID: 5441
  Gene Symbol: EP400NL
  Gene Name: EP400 N-terminal like
  ENST ID: ENST00000407361
  CDS Start-End: 293-945
cctggtctgcactccaggaaagacgagtgcgcttagtgtgcgctgcacgtgagcagtgaagttgattccacgcgctgcgctgctcggcagctgtcccagaactgaccacggacccctccgcgggtcctgctcctgacaagggccttccggcactgggagttttgtgttagtggaaaggaagaatctaataataccaccacctttacagtaaagacgctgcgaattgacgccttttataataaagacacttatcttgcccaagagctggggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagat

SEQ ID NO: 130038 - DNA, 3697 bp, Homo sapiens
  Payload ID: 5441
  Gene Symbol: EP400NL
  Gene Name: EP400 N-terminal like
  Uniprot ID: Q6ZTU2
  ENST ID: ENST00000446190
  CDS Start-End: 237-1703
gcactggctccgcgtcggccggtcggtttggtcggttgtagtggcctcgccgcccggtccgctgtcgcagcgctcatccgcgccgggagcccttggctgcgtcgcccggcagccgcggctggagtgtagtggcgcaatcttggatcaccacaacctccgtctcccaggttcaagcgattctcccgcctcagcctcctgagtagcaattacagggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtgagagggggccctgcgggtgggcagaacatgaatgttgacctgcagggcgtgggccctgggctccagggaagcccacaggtcacgctggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcatcaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgaggacttctgcggcttttccagcccagcagcagccgctccagcaaatacatatggggactccagtacctggagatgtgaattccataaaaatggaagcatctaagaggcagtgaacactggcgcccacaggagaaccaggtgcatcagcgcattgcggagctgaggaaagcaggtctgtggtcccagaggcgtctgctgaagctgcaggaggcccacgacccaagtcccactgggactatctgctggaggagatgcagtggatggccacagactttgcccaggagaggtggaaggtggcctctgtgaagaagatggtcagagctgtggcccggcagctgcaggacaggacgcgcagggaggccggggccaggagggaggagccgagcaggctgaggcagacgtcacctgtactaccagagaaatcgagcgtccctggtctagtactgcgcaggtaaagattccagcatcttggaagcaagtgctccactggaaaataaaagccacgtggtgagtgttttctttgtgatatcagaacttcatgttccgggtgaggggcttcagggtgcccgtgtccttgccggggggctccggtctccagtctcctcagcatttccctctggtctccctccagagaggacagatctactcacgatctttgggaccacccagaaagggtcaatttcaaaatcgaattttctcaggatgacttcaaatcaaaacagaaacgtgtggtcttgcctttggtttttccgcccaaactgccttttggctttgccgtgtggggaccgggcacctcgactgtcctctgtgtcctgtgatggggcaggttacgccatgtctgatcagtaggacagcgtcccttgggttcataccctttatctgcagttctaaaactctgaaagctcagacagcagaaaggttttgcccactcagtgttgctcactcattttgcagcaaacctgacccacaccgaggccaggccagccccgcggtcctggtgggtgagtgtgtctgggtgctattgctgtggaaacgtcggcgtgtttggtcatggctgccagatgccgtccctaacactttcccatgcttatttgacttatgtcattaccttacttctctgaaacagtctgaattccaaaccctgtgtggccctaaggattttggataagggactatgtacctataatataaataagccatattatttacaatcatgagtttctgaatgttcactttttttatttttggagacagagtcttgttctgtcacccaggctttagagtaccacagtgtgatctcggctcaccgcagcctccgcctcctgggttcaagcgattctcctgccttagcctcctcggtagctgggactacgggcatgagccaccagatccaactaattttttgtatttttagtagagacggggtttcaccatgttggccaggctggtcttgagctcctgatctcaggtgatctgcccgtctcaccctcccaaagggctgggattacaggtgtgagccactgtgcccagccagaatattcacttctaaatgtgggtgtgtattcaggtgacttgggattaaaaaaaaaagaaaaaacccttatgggattttatatttagaagttctgttgttgaaatatgaacctgtatctgttgttgcagtggcagaaggctgcagcacaatgaatgattattgtgaaagctggtaattttgtgcccacaaataattgtcaagaactttctaataataaaatacagaaatagattaatagttgctacaaacataaagagagactccatggtagaacactttaggaagcacattttatcttttttgaaccaacatgtatttccaaacatgtaagtaataatatcaagcgtggtgggaagattggattggaggctgattctgatctgtgtgttgggatgaactgtggcattcacagcattgagcaaaatcatcttcaaggacagcgtttaattctgttgttgacaagtcttttaagaaaaagtactagtttgggaatttttcacagatacaaataagcttgacccctaaatttaaaatattatttaaaaaataaaatgtcagatttattcatctgtc

SEQ ID NO: 130039 - DNA, 781 bp, Homo sapiens
  Payload ID: 5441
  Gene Symbol: EP400NL
  Gene Name: EP400 N-terminal like
  ENST ID: ENST00000454179
  CDS Start-End: 112-781
gtcggttgtagtggcctcgccgcccggtccgctgtcgcagcgctcatccgcgccgggagcccttggctgcgtcgcccggcagccgcgggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccg

SEQ ID NO: 130040 - DNA, 1756 bp, Homo sapiens
  Payload ID: 5441
  Gene Symbol: EP400NL
  Gene Name: EP400 N-terminal like
  Uniprot ID: Q6ZTU2
  ENST ID: ENST00000443539
  CDS Start-End: 542-1612
gccgcccggtccgctgtcgcagcgctcatccgcgccgggagcccttggctgcgtcgcccggcagccgcgcctcgcgagaccgctgtctacggcgctgacgccgcctctgcctcttgaccccttggccccgctgtcctgatccctgaggtcggggcctggtctgcactccaggaaagacgagtgcgcttagtgtgcgctgcacgtgagcagtgaagttgattccacgcgctgcgctgctcggcagctgtcccagaactgaccacggacccctccgcgggtcctgctcctgacaagggccttccggcactgggagttttgtgttagtggaaaggaagaatctaataataccaccacctttacagtaaagacgctgcgaattgacgccttttataataaagacacttatcttgcccaagagctgggctggagtgtagtggcgcaatcttggatcaccacaacctccgtctcccaggttcaagcgattctcccgcctcagcctcctgagtagcaattacagggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcatcaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggctcttagttttaatgcatggatgctgttatttttccctactgttactgaaattaaaaagtgtttgtctctg

SEQ ID NO: 130041 - DNA, 583 bp, Homo sapiens
  Payload ID: 5441
  Gene Symbol: EP400NL
  Gene Name: EP400 N-terminal like
  ENST ID: ENST00000539205
  CDS Start-End: 116-583
gaagaatctaataataccaccacctttacagtaaagacgctgcgaattgacgccttttataataaagacacttatcttgcccaagagctggggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccac

SEQ ID NO: 130042 - DNA, 2599 bp, Homo sapiens
  Payload ID: 5442
  Gene Symbol: EPDR1
  Gene Name: ependymin related 1
  Uniprot ID: Q9UM22
  ENST ID: ENST00000199448
  CDS Start-End: 380-1054
tcccccctcttaaaacacgatgcctcccaggatgctagtggcaccactgccactgcatttcctgttggcagcagtgagcagtgaaaaccgaagcggcagaaggcagtggcagcaggcagtggcagcaggcagtggcccaggcagaaatagctcccgcgcgattcactggagccttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgaccgcgatgccaggacgcgctcccctccgcaccgtcccgggcgccctgggtgcctggctgctgggcggcctctgggcctggaccctgtgcggcctgtgcagcctgggggcggtgggagccccgcgcccgtgccaggcgccgcagcagtgggaggggcgccaggttatgtaccagcaaagtagcgggcgcaacagccgcgccctgctctcctacgacgggctcaaccagcgcgtgcgggtgctggacgagaggaaggcgctgatcccctgcaagagattatttgaatatattttgctgtataaggatggagtgatgtttcagattgaccaagccaccaagcagtgctcaaagatgaccctgacacagccctgggatcctcttgacattcctcaaaactccacctttgaagaccagtactccatcggggggcctcaggagcagatcaccgtccaggagtggtcggacagaaagtcagctagatcctatgaaacctggattggcatctatacagtcaaggattgctatcctgtccaggaaacctttaccataaactacagtgtgatattgtctacgcggttttttgacatccagctgggtattaaagacccctcggtgtttacccctccaagcacgtgccagatggcccaactggagaagatgagcgaagactgctcctggtgagcctgtgcatagggaagcggcagcatcggatgtcagccccctgcggccccagctggagatggatatgagactagtcaagatgtgaatgctaattggagagaaatataattttaggaagatgcacattgatgtggggttttgatgtgtctgattttgactactcaagctctgtttacagaagaaaattgaatggcgagggtgtggccatatgaactgactagatggctaatatggacactttgggtatttctaatgcctgttcagggctggttttctgcatgcacgggtatacacataatgcagtgccatgcacatagggaagggtcagtaagagaagtttgccttggcagcaagtatttattgttgacattattcagaattagtgataataaaaagcagagtgattttggtcaattttattattaattcttaaattccctgcagagaatgccccctttattgctgcaccagggttggcattgctcccactgagccctactccaccctgtccctgcactcccttggttgccaaaaaaatgataacttaaatcccttccagacttaagaattttatggcatggcccaattgatataaacatttagaaggaaatgaaaagctaaaataggaagtaattattcctctaaagaaacattttgagcaaggcagtttagagaatcctaatgtctacactggcatagcacgagccatgtaagcttcttttttttctatgcaagagtattgatgtatgtgctgaatcttcacagacttgtcaatacacaggcagtattctaaaatagcactgaacagggagtcaggagactattgtctcctaaacccaggactagagttccctcgtactgtcactcctttggtcattaaatgcactgggcttgcccgcactttggccttcctagaacactgcttcataacctctctgtctgacttctgcatctccttccaggtcagctcattcacaagagttgctcccaagcctggatgagttgcaccttgcatcttgagcatgcatttctcacaataattattaagctgtgtgataatttctgctttcaggacactcatccattatcttggctgtgagctccttgggtacgggtaccttgtatgtttacttttatatccctagcacaaagcaagtgcctggcacatagtcagtgccctaagtattcgtagagtgaagaatgccagcctctcttgtccctggtttccttatgtgttgaatgtggttgagtttgtccattgctagggagagacttccagtaataaaatttactattctagatgcttctactgttatgttttatctgcccatttatctttcttagttaccaggagaaatgtgtgacacctatattataatgaaaacaatctcattacttatagtttatctatattaaacaaatttaattgcattttaaagcattctttgatactgttgcttttgcaataaatatggataatcttggttataagggagttaaaacaatgctgtaataaataaagtgcttcatgtgatcaaaatcaaa

SEQ ID NO: 130043 - DNA, 638 bp, Homo sapiens
  Payload ID: 5442
  Gene Symbol: EPDR1
  Gene Name: ependymin related 1
  Uniprot ID: Q9UM22
  ENST ID: ENST00000423717
  CDS Start-End: 283-555
agaaggcagtggcagcaggcagtggcagcaggcagtggcccaggcagaaatagctcccgcgcgattcactggagccttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgaccgcgatgccaggacgcgctcccctccgcaccgtcccgggcgccctgggtgcctggctgctgggcggcctctgggcctggaccctgtgcggcctgtgcagcctgggggcggtgggagccccgcgcccgtgccaggcgccgcagcagtgggaggggcgccaggttatgtaccagcaaagtagcgggcgcaacagccgcgccctgctctcctacgacgggctcaaccagcgcgtgcgggtgctggacgagaggaaggcgctgatcccctgcaagagatgaaacctggattggcatctatacagtcaaggattgctatcctgtccaggaaacctttaccataaactacagtgtgatattgtcta

SEQ ID NO: 130044 - DNA, 947 bp, Homo sapiens
  Payload ID: 5442
  Gene Symbol: EPDR1
  Gene Name: ependymin related 1
  Uniprot ID: Q9UM22
  ENST ID: ENST00000425345
  CDS Start-End: 47-538
cttctcccagagagatctttcgcgaggagggtctcttggggatagcatggtccgggactgggaggggcgctgcgcccaccgagggcggcctgctggcgggggactcagtaacacccagcgaggcggtggcagattatttgaatatattttgctgtataaggatggagtgatgtttcagattgaccaagccaccaagcagtgctcaaagatgaccctgacacagccctgggatcctcttgacattcctcaaaactccacctttgaagaccagtactccatcggggggcctcaggagcagatcaccgtccaggagtggtcggacagaaagtcagctagatcctatgaaacctggattggcatctatacagtcaaggattgctatcctgtccaggaaacctttaccataaactacagtgtgatattgtctacgcggttttttgacatccagctgggtattaaagacccctcggtgtttacccctccaagcacgtgccagatggcccaactggagaagatgagcgaagactgctcctggtgagcctgtgcatagggaagcggcagcatcggatgtcagccccctgcggccccagctggagatggatatgagactagtcaagatgtgaatgctaattggagagaaatataattttaggaagatgcacattgatgtggggttttgatgtgtctgattttgactactcaagctctgtttacagaagaaaattgaatggcgagggtgtggccatatgaactgactagatggctaatatggacactttgggtatttctaatgcctgttcagggctggttttctgcatgcacgggtatacacataatgcagtgccatgcacatagggaagggtcagtaagagaagtttgccttggcagcaagtatttattgttgacattattcagaattagtgataataaaaagcagagtgattttg

SEQ ID NO: 130045 - DNA, 555 bp, Homo sapiens
  Payload ID: 5442
  Gene Symbol: EPDR1
  Gene Name: ependymin related 1
  ENST ID: ENST00000476620
  CDS Start-End: 171-539
tttggaaggcagacatgtggcccatctctgtagccatcactgagaaatctggattttcaaggcagaagctgacaacattgtgactttgcagccatttagagataaatgtgaacctgtttttctctttagtgttattatttgaatatattttgctgtataaggatggagtgatgtttcagattgaccaagccaccaagcagtgctcaaagatgaccctgacacagccctgggatcctcttgacattcctcaaaactccacctttgaagaccagtactccatcggggggcctcaggagcagatcaccgtccaggagtggtcggacagaaagtcagctagatcctatgaaacctggattggcatctatacagtcaaggattgctatcctgtccaggaaacctttaccataaactacagtgtgatattgtctacgcggttttttgacatccagctgggtattaaagacccctcggtgtttacccctccaagcacgtgccagatggcccaactggagaagatgagcgaagactgctcctggtgagcctgtgcatagggaa

SEQ ID NO: 130046 - DNA, 3363 bp, Homo sapiens
  Payload ID: 5443
  Gene Symbol: EPHA1
  Gene Name: EPH receptor A1
  Uniprot ID: P21709
  ENST ID: ENST00000275815
  CDS Start-End: 88-3018
gcccccgcccggcccgcccggctctcctagtcccttgcaacctggcgctgccatccgggccactgtcccaggtcccggcccggagctatggagcggcgctggcccctggggctagggctggtgctgctgctctgcgccccgctgcccccgggggcgcgcgccaaggaagttactctgatggacacaagcaaggcacagggagagctgggctggctgctggatcccccaaaagatgggtggagtgaacagcaacagatactgaatgggacacccctgtacatgtaccaggactgcccaatgcaaggacgcagagacactgaccactggcttcgctccaattggatctaccgcggggaggaggcttcccgcgtccacgtggagctgcagttcaccgtgcgggactgcaagagtttccctgggggagccgggcctctgggctgcaaggagaccttcaaccttctgtacatggagagtgaccaggatgtgggcattcagctccgacggcccttgttccagaaggtaaccacggtggctgcagaccagagcttcaccattcgagaccttgtgtctggctccgtgaagctgaatgtggagcgctgctctctgggccgcctgacccgccgtggcctctacctcgctttccacaacccgggtgcctgtgtggccctggtgtctgtccgggtcttctaccagcgctgtcctgagaccctgaatggcttggcccaattcccagacactctgcctggccccgctgggttggtggaagtggcggggacctgcttgccccacgcgcgggccagccccaggccctcaggtgcaccccgcatgcactgcagccctgatggcgagtggctggtgcctgtaggacggtgccactgtgagcctggctatgaggaaggtggcagtggcgaagcatgtgttgcctgccctagcggctcctaccggatggacatggacacaccccattgtctcacgtgcccccagcagagcactgctgagtctgagggggccaccatctgtacctgtgagagcggccattacagagctcccggggagggcccccaggtggcatgcacaggtcccccctcggccccccgaaacctgagcttctctgcctcagggactcagctctccctgcgttgggaacccccagcagatacggggggacgccaggatgtcagatacagtgtgaggtgttcccagtgtcagggcacagcacaggacggggggccctgccagccctgtggggtgggcgtgcacttctcgccgggggcccgggggctcaccacacctgcagtgcatgtcaatggccttgaaccttatgccaactacacctttaatgtggaagcccaaaatggagtgtcagggctgggcagctctggccatgccagcacctcagtcagcatcagcatggggcatgcagagtcactgtcaggcctgtctctgagactggtgaagaaagaaccgaggcaactagagctgacctgggcggggtcccggccccgaagccctggggcgaacctgacctatgagctgcacgtgctgaaccaggatgaagaacggtaccagatggttctagaacccagggtcttgctgacagagctgcagcctgacaccacatacatcgtcagagtccgaatgctgaccccactgggtcctggccctttctcccctgatcatgagtttcggaccagcccaccagtgtccaggggcctgactggaggagagattgtagccgtcatctttgggctgctgcttggtgcagccttgctgcttgggattctcgttttccggtccaggagagcccagcggcagaggcagcagaggcagcgtgaccgcgccaccgatgtggatcgagaggacaagctgtggctgaagccttatgtggacctccaggcatacgaggaccctgcacagggagccctggactttacccgggagcttgatccagcgtggctgatggtggacactgtcataggagaaggagagtttggggaagtgtatcgagggaccctgaggctccccagccaggactgcaagactgtggccattaagaccttaaaagacacatccccaggtggccagtggtggaacttccttcgagaggcaactatcatgggccagtttagccacccgcatattctgcatctggaaggcgtcgtcacaaagcgaaagccgatcatgatcatcacagaatttatggagaatggagccctggatgccttcctgagggagcgggaggaccagctggtccctgggcagctagtggccatgctgcagggcatagcatctggcatgaactacctcagtaatcacaattatgtccaccgggacctggctgccagaaacatcttggtgaatcaaaacctgtgctgcaaggtgtctgactttggcctgactcgcctcctggatgactttgatggcacatacgaaacccagggaggaaagatccctatccgttggacagcccctgaagccattgcccatcggatcttcaccacagccagcgatgtgtggagctttgggattgtgatgtgggaggtgctgagctttggggacaagccttatggggagatgagcaatcaggaggttatgaagagcattgaggatgggtaccggttgccccctcctgtggactgccctgcccctctgtatgagctcatgaagaactgctgggcatatgaccgtgcccgccggccacacttccagaagcttcaggcacatctggagcaactgcttgccaacccccactccctgcggaccattgccaactttgaccccaggatgactcttcgcctgcccagcctgagtggctcagatgggatcccatatcgaaccgtctctgagtggctcgagtccatacgcatgaaacgctacatcctgcacttccactcggctgggctggacaccatggagtgtgtgctggagctgaccgctgaggacctgacgcagatgggaatcacactgcccgggcaccagaagcgcattctttgcagtattcagggattcaaggactgatccctcctctcaccccatgcccaatcagggtgcaaggagcaaggacggggccaaggtcgctcatggtcactccctgcgccccttcccacaacctgccagactaggctatcggtgctgcttctgcccactttcaggagaaccctgctctgcaccccagaaaacctctttgttttaaaagggaggtgggggtagaagtaaaaggatgatcatgggagggagctgaggggttaatatatatacatacatacacatatatatatttttgtaaataaacaggaactgattttctgcctccatcccacccatgagggctgcaggcactacaaaagagctgactactgagaa

SEQ ID NO: 130047 - DNA, 2050 bp, Homo sapiens
  Payload ID: 5444
  Gene Symbol: EPHA10
  Gene Name: EPH receptor A10
  Uniprot ID: Q5JZY3
  ENST ID: ENST00000319637
  CDS Start-End: 68-955
attgctcagcggtgctaggctggcgcggcttgagccgccgccggactgacagctcggtctgcggaccatggagacctgcgccggtccacacccgctgcgcctcttcctctgccggatgcagctctgtctcgcgctgcttttgggaccctggcggcctgggaccgccgaggaagttatcctcctggattccaaagcctcccaggccgagctgggctggactgcactgccaagtaatgggtgggaggagatcagcggcgtggatgaacacgaccgtcccatccgcacgtaccaagtgtgcaatgtgctggagcccaaccaggacaactggctgcagactggctggataagccgtggccgcgggcagcgcatcttcgtggaactgcagttcacactccgtgactgcagcagcatccctggcgccgcgggtacctgcaaggagaccttcaacgtctactacctggaaactgaggccgacctgggccgtgggcgtccccgcctaggcggcagccggccccgcaaaatcgacacgatcgcggcggacgagagcttcacgcagggcgacctgggtgagcgcaagatgaagctgaacacagaggtgcgcgagatcggaccgctcagccggcggggtttccacctggcctttcaggacgtgggcgcatgcgtggcgcttgtctcggtgcgcgtctactacaagcagtgccgcgccaccgtgcggggcctggccacgttcccagccaccgcagccgagagcgccttctccacactggtggaagtggccggaacgtgcgtggcgcactcggaaggggagcctggcagccccccacgcatgcactgcggcgccgacggcgagtggctggtgcctgtgggccgctgcagctgcagcgcgggattccaggagcgtggtgacttctgcgaaggtatccagttggctgggggccgtggggtgggagtgtagagcgtaggtggcaattgagagagagtgtgccctagaggaaagaggcgggtgtggggtcggggggcggtggagaagccttggactctggagcccaaggagagccctgaagtcttgtggagtttccagtgagtccagtcagggccaatgagtgaacttactagatgaaattgactggctaaggaggcattagggatctatatcttaggcaccttgcacaggccttctcgtttatttattttcatggcaataaaggaagtcattgtttttttttttttttaaaataaggagtctctcttgctctgttgcccaggctggagtgcactggcttgatcttggctaactgcaacttccacctcctgggttcaagcaattctcctgcctcagcctcctgagtagctgggattataggcgtgcaccaccatgcccagctaatttttgtatttttagtagagacggggtttcaccatgttggccaggctggtctcaaactcctgacctcaagtgatccacctacctaggccttccagagtgctgggattataggcgtgagccaccgtgcctggcctaaaggaagtcattcttatctctatttcacagatgaagaaacagagcctcagagagattagtacctcacttgcaaagttaggaaatggggagctaggatttgaattcaggcttgcccaactcacattctatgacatcatgaggtctcctcagtgcataaggaagaactctacagcagcccaatcttcaggctagtgggattggttgcattacagagaggaatctcccagtcacggaccaaatacttgcaagttagaggctggcaggggggatttttatgctggagagagggattgggaagttgcactagatgattacgaagatcacatcccactctctgaactacaatcactgtgctccctgggggagatccttcatgttgagggttttgctgggttctcaggctagtgggggcattaggaacagacctctcattctctctcttgcctgtggctttggatacagagggtgatgatggggttattaatgtgtgtacttaatatagaaagatcaaggtatgctttttctaaa

SEQ ID NO: 130048 - DNA, 5425 bp, Homo sapiens
  Payload ID: 5444
  Gene Symbol: EPHA10
  Gene Name: EPH receptor A10
  Uniprot ID: Q5JZY3
  ENST ID: ENST00000373048
  CDS Start-End: 1-3027
atggagacctgcgccggtccacacccgctgcgcctcttcctctgccggatgcagctctgtctcgcgctgcttttgggaccctggcggcctgggaccgccgaggaagttatcctcctggattccaaagcctcccaggccgagctgggctggactgcactgccaagtaatgggtgggaggagatcagcggcgtggatgaacacgaccgtcccatccgcacgtaccaagtgtgcaatgtgctggagcccaaccaggacaactggctgcagactggctggataagccgtggccgcgggcagcgcatcttcgtggaactgcagttcacactccgtgactgcagcagcatccctggcgccgcgggtacctgcaaggagaccttcaacgtctactacctggaaactgaggccgacctgggccgtgggcgtccccgcctaggcggcagccggccccgcaaaatcgacacgatcgcggcggacgagagcttcacgcagggcgacctgggtgagcgcaagatgaagctgaacacagaggtgcgcgagatcggaccgctcagccggcggggtttccacctggcctttcaggacgtgggcgcatgcgtggcgcttgtctcggtgcgcgtctactacaagcagtgccgcgccaccgtgcggggcctggccacgttcccagccaccgcagccgagagcgccttctccacactggtggaagtggccggaacgtgcgtggcgcactcggaaggggagcctggcagccccccacgcatgcactgcggcgccgacggcgagtggctggtgcctgtgggccgctgcagctgcagcgcgggattccaggagcgtggtgacttctgcgaagcctgtcccccagggttttacaaggtgtccccgcggcggcccctctgctcaccgtgcccagagcacagccgggccctggaaaacgcctccaccttctgcgtgtgccaggacagctatgcgcgctcacccaccgacccgccctcggcttcctgcacccggccgccgtcggcgccgcgggacctgcagtacagcctgagccgctcgccgctggtgctgcgactgcgctggctgccgccggccgactcgggaggccgctcggacgtcacctactcgctgctgtgcctgcgctgcggccgcgagggcccggcgggcgcctgcgagccgtgcgggccgcgcgtggccttcctaccgcgccaggcagggctgcgggagcgagccgccacgctgctgcacctgcggcccggcgcgcgctacaccgtgcgcgtggccgcgctcaacggcgtctcgggcccggcggccgccgcgggaaccacctacgcgcaggtcaccgtctccaccgggcccggggcgccctgggaggaggatgagatccgcagggaccgagtggaaccccagagcgtgtccctgtcgtggcgggagcccatccctgccggagcccctggggccaatgacacggagtacgagatccgatactacgagaagggtcagagtgagcagacttactccatggtgaagacaggggcgcccacagtcaccgtcaccaacctgaagccggctacccgctacgtctttcagatccgggccgcttccccggggccatcctgggaggcccagagttttaaccccagcattgaagtacagaccctgggggaggctgcctcagggtccagggaccagagccccgccattgtcgtcaccgtagtgaccatctcggccctcctcgtcctgggctccgtgatgagtgtgctggccatttggaggaggccctgcagctatggcaaaggaggaggggatgcccatgatgaagaggagctgtatttccacttcaaagtcccaacacgtcgcacattcctggacccccagagctgtggggacctgctgcaggctgtgcatctgttcgccaaggaactggatgcgaaaagcgtcacgctggagaggagccttggaggagggcggtttggggagctgtgctgtggctgcttgcagctccccggtcgccaggagctgctcgtagccgtgcatatgctgagggacagcgcctccgactcacagaggctcggcttcctggccgaggccctcacgctgggccagtttgaccatagccacatcgtgcggctggagggcgttgttacccgaggaagcaccttgatgattgtcaccgagtacatgagccatggggccctggacggcttcctcaggcggcacgaggggcagctggtggctgggcaactgatggggttgctgcctgggctggcatcagccatgaagtatctgtcagagatgggctacgttcaccggggcctggcagctcgccatgtgctggtcagcagcgaccttgtctgcaagatctctggcttcgggcggggcccccgggaccgatcagaggctgtctacaccactatgagtggccggagcccagcgctatgggccgctcccgagacacttcagtttggccacttcagctctgccagtgacgtgtggagcttcggcatcatcatgtgggaggtgatggcctttggggagcggccttactgggacatgtctggccaagacgtgatcaaggctgtggaggatggcttccggctgccaccccccaggaactgtcctaaccttctgcaccgactaatgctcgactgctggcagaaggacccaggtgagcggcccaggttctcccagatccacagcatcctgagcaagatggtgcaggacccagagccccccaagtgtgccctgactacctgtcccaggcctcccaccccactagcggaccgtgccttctccaccttcccctcctttggctctgtgggcgcgtggctggaggccctggacctgtgccgctacaaggacagcttcgcggctgctggctatgggagcctggaggccgtggccgagatgactgcccaggacctggtgagcctaggcatctctttggctgaacatcgagaggccctcctcagcgggatcagcgccctgcaggcacgagtgctccagctgcagggccagggggtgcaggtgtgagtggaccccattcttccaaggcaggactccggtgggggtccagtcccccagccctgcccaaggaccgtggcaagctgcgctccagcagtgtgggagggagcgctctcttcctctgcttgggcccagatctggtggggccacagcttccccgctttcactgcctgcccctcccattttcacgagtctgaacgccttggctaactcagtgcccctgaaaagaggttcaaatccctagggaggacccctgagataacagcaggaggaaattcggggtctcagagaaaagctggggcagggatgggagggaagacagtgggttgagattgccctggctcatgccctactgccatttgtacccactgggggctggggcctaccccgtggggtgttcccttttcccacagacccattgaccagtcagacagcgtgggtcctgggggggtcttcttctacctggcagtgactgcagctgcctggtggctcaggcgtcgggggctgggccagaggtgcatccacctcagctccctgtgccttggcaggggctgactggacactggccaaggctcaggcaggcaaagatggtgctgagctcaggggctgatacccaagagccctagactcaggatctggtttctgtgtccccctgccttgggctgacagttcagggtgaggccaaaagtcctggccaggccgggccatgagaggccctggtgctccctggggccccatgaggccctcgtgtgcattccttttatgaacttagtggccaggacatctgggaaaagcataaagggccatgttatctccccagggacccaagagcttttctctccagccatggggagggtgaagaggagactcagagatgggtcctctctctcaaacaggctggtctaacccccagtgtacagatgggggaaactgaggccaagtgaggagtcaggagcagagctgaggtcagaacccaatccaggggtaaggctggctctggggagagagtccttggtcctgccctatggcaccaccacttccctgtacagcccttggggactctagaggcgactcccctccagccagctccgtgccttgggcactacccagccttccatggagcccctccctgctctgactttgaagagccctggcagaagtggttgtgctgagcccaccgtggagttccttatccacaagggcccccgggaatggtggggcccagtatgccagagctttcgtagggtggcaggaaggcagctggatctcagcagggccacagggactgagtttgtttaggccgcccgtgacacttgtctgctctgcttggctgtgtgttggtggggtgggatggggcgggaaagaggagacaagaggtaaagatgaaaaagacacacagcctgcccttggggggctcagactagaccaggagaagagctcaggtaccaagaagtaattccagggcaccatccacagtgcccagggccccccaggagccctctgggtcagtgggtaggtgggctggagggggagatagccactctcttaatgtgtgaagttgagatgtaagttgaacagggccttgcaggtgggaaagggaaggttctttccttggggtgggtggagttttcggcaggcaagatggcaggcctcggacaaaaggagtccatgcagagaggctagcatgagaaagagcccagaggcgggaaggtgcagtgcctctttgcagagcacccagaggtgggggacagtgactcacagaggtgcctttggccttaccctgccagcagcagctcccctgctcttggaatctccccccagccccctgcctccctgtctcctgagcacctgccccagctcagtgactctgggggtactggggagaccaagatgttgctaccaccttagtcagggttgggggagcccccggccaggtgccctccaggatccgccttccccacccctcctgggaagcctggaccagcatcccttcttgggtggatggagcctcgtcctcatctccagctacatcagtcattctctgcagggcaaaatctcctccccctaccccagctgtttctgcagaagggcccctggctgtgttggcaggacttcggtgtccagggtagatctcccctccactgaggagtgaggtcccagaatcctgttgggtcccaggcctcagccctgcacagatgtgatgtggggcgatggctctctgggaaccctctacagatctatttttatatggaacttgttcactggacagaggtggcctgcaagcccccattaccctggtctgagctcaccctgggagggagggggccagtcggagggggttccttctggagatgtttttatatttcttgggttctctatgcaggataataaaaacttgtctgtgata

SEQ ID NO: 130049 - DNA, 3167 bp, Homo sapiens
  Payload ID: 5444
  Gene Symbol: EPHA10
  Gene Name: EPH receptor A10
  ENST ID: ENST00000427468
  CDS Start-End: 1-3045
atggagacctgcgccggtccacacccgctgcgcctcttcctctgccggatgcagctctgtctcgcgctgcttttgggaccctggcggcctgggaccgccgaggaagttatcctcctggattccaaagcctcccaggccgagctgggctggactgcactgccaagtaatgggtgggaggagatcagcggcgtggatgaacacgaccgtcccatccgcacgtaccaagtgtgcaatgtgctggagcccaaccaggacaactggctgcagactggctggataagccgtggccgcgggcagcgcatcttcgtggaactgcagttcacactccgtgactgcagcagcatccctggcgccgcgggtacctgcaaggagaccttcaacgtctactacctggaaactgaggccgacctgggccgtgggcgtccccgcctaggcggcagccggccccgcaaaatcgacacgatcgcggcggacgagagcttcacgcagggcgacctgggtgagcgcaagatgaagctgaacacagaggtgcgcgagatcggaccgctcagccggcggggtttccacctggcctttcaggacgtgggcgcatgcgtggcgcttgtctcggtgcgcgtctactacaagcagtgccgcgccaccgtgcggggcctggccacgttcccagccaccgcagccgagagcgccttctccacactggtggaagtggccggaacgtgcgtggcgcactcggaaggggagcctggcagccccccacgcatgcactgcggcgccgacggcgagtggctggtgcctgtgggccgctgcagctgcagcgcgggattccaggagcgtggtgacttctgcgaagcctgtcccccagggttttacaaggtgtccccgcggcggcccctctgctcaccgtgcccagagcacagccgggccctggaaaacgcctccaccttctgcgtgtgccaggacagctatgcgcgctcacccaccgacccgccctcggcttcctgcacccggccgccgtcggcgccgcgggacctgcagtacagcctgagccgctcgccgctggtgctgcgactgcgctggctgccgccggccgactcgggaggccgctcggacgtcacctactcgctgctgtgcctgcgctgcggccgcgagggcccggcgggcgcctgcgagccgtgcgggccgcgcgtggccttcctaccgcgccaggcagggctgcgggagcgagccgccacgctgctgcacctgcggcccggcgcgcgctacaccgtgcgcgtggccgcgctcaacggcgtctcgggcccggcggccgccgcgggaaccacctacgcgcaggtcaccgtctccaccgggcccggggcgccctgggaggaggatgagatccgcagggaccgagtggaaccccagagcgtgtccctgtcgtggcgggagcccatccctgccggagcccctggggccaatgacacggagtacgagatccgatactacgagaagggtcagagtgagcagacttactccatggtgaagacaggggcgcccacagtcaccgtcaccaacctgaagccggctacccgctacgtctttcagatccgggccgcttccccggggccatcctgggaggcccagagttttaaccccagcattgaagtacagaccctgggggaggctgcctcagggtccagggaccagagccccgccattgtcgtcaccgtagtgaccatctcggccctcctcgtcctgggctccgtgatgagtgtgctggccatttggaggaggccctgcagctatggcaaaggaggaggggatgcccatgatgaagaggagctgtatttccacttcaaagtcccaacacgtcgcacattcctggacccccagagctgtggggacctgctgcaggctgtgcatctgttcgccaaggaactggatgcgaaaagcgtcacgctggagaggagccttggaggagggcggtttggggagctgtgctgtggctgcttgcagctccccggtcgccaggagctgctcgtagccgtgcatatgctgagggacagcgcctccgactcacagaggctcggcttcctggccgaggccctcacgctgggccagtttgaccatagccacatcgtgcggctggagggcgttgttacccgaggaagcaccttgatgattgtcaccgagtacatgagccatggggccctggacggcttcctcaggcggcacgaggggcagctggtggctgggcaactgatggggttgctgcctgggctggcatcagccatgaagtatctgtcagagatgggctacgttcaccggggcctggcagctcgccatgtgctggtcagcagcgaccttgtctgcaagatctctggcttcgggcggggcccccgggaccgatcagaggctgtctacaccactatgagtggccggagcccagcgctatgggccgctcccgagacacttcagtttggccacttcagctctgccagtgacgtgtggagcttcggcatcatcatgtgggaggtgatggcctttggggagcggccttactgggacatgtctggccaagacgtgatcaaggctgtggaggatggcttccggctgccaccccccaggaactgtcctaaccttctgcaccgactaatgctcgactgctggcagaaggacccaggtgagcggcccaggttctcccagatccacagcatcctgagcaagatggtgcaggacccagagccccccaagtgtgccctgactacctgtcccaggcctcccaccccactagcggaccgtgccttctccaccttcccctcctttggctctgtgggcgcgtggctggaggccctggacctgtgccgctacaaggacagcttcgcggctgctggctatgggagcctggaggccgtggccgagatgactgcccaggacctggtgagcctaggcatctctttggctgaacatcgagaggccctcctcagcgggatcagcgccctgcaggcacgagtgctccagctgcagggccagggggtgcaggtgataataaaaacttgtctgtgatatggtgcctctttgagtggcagttgcttgatcattgtatagctggtgtggaagggcttctgcccccttcctcgaggacaggggtgtccagaatctgcgtctgagatctctctgcatagagg

SEQ ID NO: 130050 - DNA, 1944 bp, Homo sapiens
  Payload ID: 5444
  Gene Symbol: EPHA10
  Gene Name: EPH receptor A10
  ENST ID: ENST00000534097
  CDS Start-End: 1-1179
gagcagacttactccatggtgaagacaggggcgcccacagtcaccgtcaccaacctgaagccggctacccgctacgtctttcagatccgggccgcttccccggggccatcctgggaggcccagagttttaaccccagcattgaagtacagaccctgggggaggctgcctcagggtccagggaccagagccccgccattgtcgtcaccgtagtgaccatctcggccctcctcgtcctgggctccgtgatgagtgtgctggccatttggaggaggccctgcagctatggcaaaggaggaggggatgcccatgatgaagaggagctgtatttccacttcaaagtcccaacacgtcgcacattcctggacccccagagctgtggggacctgctgcaggctgtgcatctgttcgccaaggaactggatgcgaaaagcgtcacgctggagaggagccttggaggagggcggtttggggagctgtgctgtggctgcttgcagctccccggtcgccaggagctgctcgtagccgtgcatatgctgagggacagcgcctccgactcacagaggctcggcttcctggccgaggccctcacgctgggccagtttgaccatagccacatcgtgcggctggagggcgttgttacccgaggaagcaccttgatgattgtcaccgagtacatgagccatggggccctggacggcttcctcaggcggcacgaggggcagctggtggctgggcaactgatggggttgctgcctgggctggcatcagccatgaagtatctgtcagagatgggctacgttcaccggggcctggcagctcgccatgtgctggtcagcagcgaccttgtctgcaagatctctggcttcgggcggggcccccgggaccgatcagaggctgtctacaccactatgagtggccggagcccagcgctatgggccgctcccgagacacttcagtttggccacttcagctctgccagtgacgtgtggagcttcggcatcatcatgtgggaggtgatggcctttggggagcggccttactgggacatgtctggccaagacgtgatcaaggctgtggaggatggcttccggctgccaccccccaggaactgtcctaaccttctgcaccgactaatgctcgactgctggcagaaggacccaggcctcccaccccactagcggaccgtgccttctccaccttcccctcctttggctctgtgggcgcgtggctggaggccctggacctgtgccgctacaaggacagcttcgcggctgctggctatgggagcctggaggccgtggccgagatgactgcccaggacctggtgagcctaggcatctctttggctgaacatcgagaggccctcctcagcgggatcagcgccctgcaggcacgagtgctccagctgcagggccagggggtgcaggtgataataaaaacttgtctgtgatatggtgcctctttgagtggcagttgcttgatcattgtatagctggtgtggaagggcttctgcccccttcctcgaggacaggggtgtccagaatctgcgtctgagatctctctgcatagagggatttactgtcccacagctctggaggctggaagccaagatcaagatgtgcgcaaggttgtttcctgctgagagctgtgaggggagcttctgctctgggcctctctccccggcttgcctgtggccatcttcccactctctcttcgcatcatcttccctctgtggagagcaaaatatcagctctttgataaggctaactggagaatgttgcttaccaagtttctttgaatctaagatgccattgagtgtaagatgtcctaccaagaaagaaacatcacagccaactatgttgtgccatccaactgaaagatgcatcccagtttcagagatgttaacatgtacgtcttcaataaatgagatgccgcgcatcagg

SEQ ID NO: 130051 - DNA, 2333 bp, Homo sapiens
  Payload ID: 5444
  Gene Symbol: EPHA10
  Gene Name: EPH receptor A10
  ENST ID: ENST00000437645
  CDS Start-End: 1-657
gcgcaggtcaccgtctccaccgggcccggggcgccctgggaggaggatgagatccgcagggaccgagtggaaccccagagcgtgtccctgtcgtggcgggagcccatccctgccggagcccctggggccaatgacacggagtacgagatccgatactacgagaagggtcagagtgagcagacttactccatggtgaagacaggggcgcccacagtcaccgtcaccaacctgaagccggctacccgctacgtctttcagatccgggccgcttccccggggccatcctgggaggcccagagttttaaccccagcattgaagtacagaccctgggggaggctgcctcagggtccagggaccagagccccgccattgtcgtcaccgtagtgaccatctcggccctcctcgtcctgggctccgtgatgagtgtgctggccatttggaggaggccctgcagctatggcaaaggaggaggggatgcccatgatgaagaggagctgtatttccacttcaaagtcccaacacgtcgcacattcctggacccccagagctgtggggacctgctgcaggctgtgcatctgttcgccaaggaactggatgcgaaaagcgtcacgctggagaggagccttggaggaggcttggaaacctccccccactgaggaaggcagagaggaatccccatttcacagaggagacaggccaagaaaaggaaagagatggaattcgaggtcacactgctggtactcagtttaccaggatttaagctggaaacagtccatgatctggagtcacttttttttttgagaccgagtcttgctctgtcacccagtctgaagtgcagtggcacaatctcagctcactgaaacctctgcctcctgggttcaagtgattttcctgcctcagcttctcaagtagctgggattacagggcggtttggggagctgtgctgtggctgcttgcagctccccggtcgccaggagctgctcgtagccgtgcatatgctgagggacagcgcctccgactcacagaggctcggcttcctggccgaggccctcacgctgggccagtttgaccatagccacatcgtgcggctggagggcgttgttacccgaggaagcaccttgatgattgtcaccgagtacatgagccatggggccctggacggcttcctcaggcggcacgaggggcagctggtggctgggcaactgatggggttgctgcctgggctggcatcagccatgaagtatctgtcagagatgggctacgttcaccggggcctggcagctcgccatgtgctggtcagcagcgaccttgtctgcaagatctctggcttcgggcggggcccccgggaccgatcagaggctgtctacaccactatgagtggccggagcccagcgctatgggccgctcccgagacacttcagtttggccacttcagctctgccagtgacgtgtggagcttcggcatcatcatgtgggaggtgatggcctttggggagcggccttactgggacatgtctggccaagacgtgatcaaggctgtggaggatggcttccggctgccaccccccaggaactgtcctaaccttctgcaccgactaatgctcgactgctggcagaaggacccaggcctcccaccccactagcggaccgtgccttctccaccttcccctcctttggctctgtgggcgcgtggctggaggccctggacctgtgccgctacaaggacagcttcgcggctgctggctatgggagcctggaggccgtggccgagatgactgcccaggacctggtgagcctaggcatctctttggctgaacatcgagaggccctcctcagcgggatcagcgccctgcaggcacgagtgctccagctgcagggccagggggtgcaggtgataataaaaacttgtctgtgatatggtgcctctttgagtggcagttgcttgatcattgtatagctggtgtggaagggcttctgcccccttcctcgaggacaggggtgtccagaatctgcgtctgagatctctctgcatagagggatttactgtcccacagctctggaggctggaagccaagatcaagatgtgcgcaaggttgtttcctgctgagagctgtgaggggagcttctgctctgggcctctctccccggcttgcctgtggccatcttcccactctctcttcgcatcatcttccctctatgccattgagtgtaagatgtcctaccaagaaagaaacatcacagccaactatgttgtgccatccaactgaaagatgcatcccagtttcagagatgttaacatgtacgtcttcaataaatgagatgccgcgcatca

SEQ ID NO: 130052 - DNA, 551 bp, Homo sapiens
  Payload ID: 5444
  Gene Symbol: EPHA10
  Gene Name: EPH receptor A10
  ENST ID: ENST00000525749
  CDS Start-End: 1-277
gcacctgcggcccggcgcgcgctacaccgtgcgcgtggccgcgctcaacggcgtctcgggcccggcggccgccgcgggaaccacctacgcgcaggtcaccgtctccaccgggcccggggcgccctgggaggaggatgagatccgcagggaccgagtggaaccccagagcgtgtccctgtcgtggcgggagcccatccctgccggagcccctggggccaatgacacggagtacgagatccgatactacgagaaggatacttgtgctgatttttgctgacctcttgtatccattgtcaatctgtggttgcagcttagctgtgatgtaacaaatggagtcacatcccaatctgctcttttccccggtcagagtgagcagacttactccatggtgaagacaggggcgcccacagtcaccgtcaccaacctgaagccggctacccgctacgtctttcagatccgggccgcttccccggggccatcctgggaggcccagagttttaaccccagcattgaagtacagaccctgggggaggctgcctcagggtccaggg

SEQ ID NO: 130053 - DNA, 2096 bp, Homo sapiens
  Payload ID: 5444
  Gene Symbol: EPHA10
  Gene Name: EPH receptor A10
  ENST ID: ENST00000432874
  CDS Start-End: 1-653
ttcagatccgggccgcttccccggggccatcctgggaggcccagagttttaaccccagcattgaagtacagaccctgggggaggctgcctcagggtccagggaccagagccccgccattgtcgtcaccgtagtgaccatctcggccctcctcgtcctgggctccgtgatgagtgtgctggccatttggaggaggccctgcagctatggcaaaggaggaggggatgcccatgatgaagaggagctgtatttccacttcaaagtcccaacacgtcgcacattcctggacccccagagctgtggggacctgctgcaggctgtgcatctgttcgccaaggaactggatgcgaaaagcgtcacgctggagaggagccttggaggaggtctctgctcgtgtctggaagccctgcctccacaccaagcccaccctccacccagaaagtccctggcttgcctgattatagggaagaggatggcagaagggtctgtgaccctctcctggtcctcaagggcggtttggggagctgtgctgtggctgcttgcagctccccggtcgccaggagctgctcgtagccgtgcatatgctgagggacagcgcctccgactcacagaggctcggcttcctggccgaggccctcacgctgggccagtttgaccatagccacatcgtgcggctggagggcgttgttacccgaggaagcaccttgatgattgtcaccgagtacatgagccatggggccctggacggcttcctcaggcggcacgaggggcagctggtggctgggcaactgatggggttgctgcctgggctggcatcagccatgaagtatctgtcagagatgggctacgttcaccggggcctggcagctcgccatgtgctggtcagcagcgaccttgtctgcaagatctctggcttcgggcggggcccccgggaccgatcagaggctgtctacaccactatggtggccggagcccagcgctatgggccgctcccgagacacttcagtttggccacttcagctctgccagtgacgtgtggagcttcggcatcatcatgtgggaggtgatggcctttggggagcggccttactgggacatgtctggccaagacgtgatcaaggctgtggaggatggcttccggctgccaccccccaggaactgtcctaaccttctgcaccgactaatgctcgactgctggcagaaggacccagactgttccggatacgccaatacctttagctggcgctggctctgcctccacctgcctgaagaacctgaagccctcgcttcttcacgaatgcacagtgctcatgcctcccaccccactagcggaccgtgccttctccaccttcccctcctttggctctgtgggcgcgtggctggaggccctggacctgtgccgctacaaggacagcttcgcggctgctggctatgggagcctggaggccgtggccgagatgactgcccaggacctggtgagcctaggcatctctttggctgaacatcgagaggccctcctcagcgggatcagcgccctgcaggcacgagtgctccagctgcagggccagggggtgcaggataataaaaacttgtctgtgatatggtgcctctttgagtggcagttgcttgatcattgtatagctggtgtggaagggcttctgcccccttcctcgaggacaggggtgtccagaatctgcgtctgagatctctctgcatagagggatttactgtcccacagctctggaggctggaagccaagatcaagatgtgcgcaaggttgtttcctgctgagagctgtgaggggagcttctgctctgggcctctctccccggcttgcctgtggccatcttcccactctctcttcgcatcatcttccctctgtggagagcaaaatatcagctctttgataaggctaactggagaatgttgcttaccaagtttctttgaatctaagatgccattgagtgtaagatgtcctaccaagaaagaaacatcacagccaactatgttgtgccatccaactgaaagatgcatcccagtttcagagatgttaacatgtacgtcttcaataaatgagatgccgcgcatcagggacaaa

SEQ ID NO: 130054 - DNA, 720 bp, Homo sapiens
  Payload ID: 5444
  Gene Symbol: EPHA10
  Gene Name: EPH receptor A10
  ENST ID: ENST00000540011
  CDS Start-End: 253-720
accgtgcgcgtggccgcgctcaacggcgtctcgggcccggcggccgccgcgggaaccacctacgcgcaggtcaccgtctccaccgggcccggggcgccctgggaggaggatgagatccgcagggaccgagtggaaccccagagcgtgtccctgtcgtggcgggagcccatccctgccggagcccctggggccaatgacacggagtacgagatccgatactacgagaagggtcagagtgagcagacttactccatggtgaagacaggggcgcccacagtcaccgtcaccaacctgaagccggctacccgctacgtctttcagatccgggccgcttccccggggccatcctgggaggcccagagttttaaccccagcattgaagtacagaccctgggggaggctgcctcagggtccagggaccagagccccgccattgtcgtcaccgtagtgaccatctcggccctcctcgtcctgggctccgtgatgagtgtgctggccatttggaggaggccctgcagctatggcaaaggaggaggggatgcccatgatgaagaggagctgtatttccacttcaaagtcccaacacgtcgcacattcctggacccccagagctgtggggacctgctgcaggctgtgcatctgttcgccaaggaactggatgcgaaaagcgtcacgctggagaggagccttggaggaggcttggaaacctccccccactga

SEQ ID NO: 130055 - DNA, 3964 bp, Homo sapiens
  Payload ID: 5445
  Gene Symbol: EPHA2
  Gene Name: EPH receptor A2
  Uniprot ID: P29317
  ENST ID: ENST00000358432
  CDS Start-End: 156-3086
ggttctcacccaacttccattaaggactcggggcaggaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatatgggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaccga

SEQ ID NO: 130056 - DNA, 5809 bp, Homo sapiens
  Payload ID: 5446
  Gene Symbol: EPHA3
  Gene Name: EPH receptor A3
  Uniprot ID: P29320
  ENST ID: ENST00000336596
  CDS Start-End: 226-3177
cccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctgctccatcacctgtcctgacgattaagaaagatcggacctccagaaatagcatctctttgtcctggcaagaacctgaacatcctaatgggatcatattggactacgaggtcaaatactatgaaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactctttctccatctctggtgaaagtagccaagtggtcatgatcgccatttcagcggcagtagcaattattctcctcactgttgtcatctatgttttgattgggaggttctgtggctataagtcaaaacatggggcagatgaaaaaagacttcattttggcaatgggcatttaaaacttccaggtctcaggacttatgttgacccacatacatatgaagaccctacccaagctgttcatgagtttgccaaggaattggatgccaccaacatatccattgataaagttgttggagcaggtgaatttggagaggtgtgcagtggtcgcttaaaacttccttcaaaaaaagagatttcagtggccattaagaccctgaaagttggctacacagaaaagcagaggagagacttcctgggagaagcaagcattatgggacagtttgaccaccccaatatcattcgactggaaggagttgttaccaaaagtaagccagttatgattgtcacagaatacatggagaatggttccttggatagtttcctacgtaaacacgatgcccagtttactgtcattcagctagtggggatgcttcgagggatagcatctggcatgaagtacctgtcagacatgggctatgttcaccgagacctcgctgctcggaacatcttgatcaacagtaacttggtgtgtaaggtttctgatttcggactttcgcgtgtcctggaggatgacccagaagctgcttatacaacaagaggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaattaaagctgtagatgagggctatcgactgccaccccccatggactgcccagctgccttgtatcagctgatgctggactgctggcagaaagacaggaacaacagacccaagtttgagcagattgttagtattctggacaagcttatccggaatcccggcagcctgaagatcatcaccagtgcagccgcaaggccatcaaaccttcttctggaccaaagcaatgtggatatcactaccttccgcacaacaggtgactggcttaatggtgtctggacagcacactgcaaggaaatcttcacgggtgtggagtacagttcttgtgacacaatagccaagatttccacagatgacatgaaaaaggttggtgtcaccgtggttgggccacagaagaagatcatcagtagcattaaagctctagaaacgcaatcaaagaatggcccagttcccgtgtaaagcacgggacggaagtgcttctggacggaagtggtggctgtggaaggcgtagcatcatcctgcagacagacaataattctggagatactggtggaagttccaagtccaataagacactcaaatatgagtacaaatgccttaaaatggaattgaaaaactctttattttcccctatcatttattggatgggtgggtggggtatttttttgtaattgcttttttaaatattagttaatggattaaatttaattcttcagcgtaaaatggtgaagaactagcatatagccattgatcataaactgactatcataaaatcaaaacaagtgaaataacaaaatggacatggtggctttgtttaggtagagccacaaaagaaaagacttgtaatatttttatatacagaggaaatctgtaacaggtattttgtttcttttaaagcaagcaacacagaggaatttatacctcaaactatctggccatatttactaccttatcactgcattattctcttttatctgtttaaagcatatagagatgaagtttgtagttgttttaagtactacacatttttaaattgttagcttccttaagtatatcatgtaaagaaatgtcttaatttttgaaaaaagtacatatttattttcttttgaattgtttttattgttttctatttatgccttgatgatttaatatggatttgttacagccaagtgccaaatgctctctcaaattgtcagcaatttaactagacacagataataatgggtttctttcagattttttgaaccatccacttacatatatttttaaaaaatgaaatccttttcctgttcatacactaaccaaatctctcaaatctgttatcccaatcattgttgcctctccgtttattataaactgtatgctcacaacttagtgtaatataccagcttgtatgcaatggattttcaaccagataacatacctttcctgctctggtgcttagagactatcaactccctcctttagtgaaggagccgtgttagagcttccgagaatagctccactggagagaagtggaatcctatatagaatgctgcactaattgacaacacagcctataggccaatgcatgagtaaaaaaaaaaacaattactggctcactggctttgaaaagtcacttactattgttgctgaaacttgctgagctgtttatagagaatgatgataacagaacttttcctctgtatcactggtgtttaggtgaattaattaaacattgtgatcattagtaccaggtattattatctttaagagtcttccacttcaatgcacatggtgcagttttggtgtgtaacttagaaggattgaacttctttgaatttactggacataacattttcagaatagttggtcatctagcaaccgcctcaaaatgtgtaagcaggagagaaatttctcatcacagggatttagacttactattacataaaggctaactatgagcttgctcattaattttgaaaagatgtacctggtggatatctagctagtaatatattctgaagcaacattttagctctattgatactctttctaatgctgatatgatcttgagtataagaaatgcatatgtcactagaatggataaaataatgctgcaaacttaatgttcttatgcaaaatggaacgctaatgaaacacagcttacaatcgcaaatcaaaactcacaagtgctcatctgttgtagatttagtgtaataagacttagattgtgctccttcggatatgattgtttctcaaatcttggcaatattccttagtcaaatcaggctactagaattctgtattggatatataagagcatgaaatttttaaaaatacacttgtgattataaaattaatcacaaatttcacttatacctgctatcagcagctagaaaacattttttttttaaatcaagtattttgtgtttggaatgttagaatgagatctgaatgtggtttcaatctaattttttcccagactactattttcttttttaggtactattctgagcatactcaacaaaacccatgcatttcataaactaatagaagttgaggattgttgaatctatttcacttattttggctgtggtttccatctgaaagtagaggttgtatacaccatatactgttcttcattttattaatatttttctccttgacctctcataaatttactttacacaattcttaccctgtacatatgtaaacataagtgtacgattcttaaccatggagtagaggtactagaatgcttacggccatctctttgtacaggaactgcattgactttcagtaaacataaagccacaactcctacatgatgttatgtaccatatgatctgttttgtatcttaaatttgatttacatatattatttatttctggtaactcactcagtttatgctgtgctaaatatcaatcaagccatgtataaatgtgatatgattggcaatatgtgtttactttaaacttgtcttttcaaaatattactcagtttatgttgtacaatgtagatggcctcttactaatgtaaaatgatttgtagtggaaacatttatatttttataataaacataatgaaaatattttttacagattggaa

SEQ ID NO: 130057 - DNA, 2546 bp, Homo sapiens
  Payload ID: 5446
  Gene Symbol: EPHA3
  Gene Name: EPH receptor A3
  Uniprot ID: P29320
  ENST ID: ENST00000452448
  CDS Start-End: 88-1707
cttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctgctccatcacctgtcctgacgattaagaaagatcggacctccagaaatagcatctctttgtcctggcaagaacctgaacatcctaatgggatcatattggactacgaggtcaaatactatgaaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactgtatgtattatttcaatgcagtctagaggagggggcagggatcttgcaaaagatgtctgatcgtttattctcactgtttctaagttttaaacaaatgtgatacatttaaggtatattgcttgggacattgcaatttgcagagccctgtgtctgtatacagtatttgtgtttgtgtgggtgtacattttgtgtttctttttttcttgtatgcaaatcaaacatattctaatgcctgaaatgcttctgttttttttttttagccataaattgcttttgaggaacattatttaatatagtaacacacttccagtgtctgtcatttcagatattccaggttcattgcgtgattcaatgaaccacaaaaaagaaacttgctgatccatgagaatcttaattttgttttaatccttaacacattcaatagcatatcacagagagaataaggattttctaaaatgtgttttatcacttcattcacattcagaagtaatttgaatagcctgttcctttaaccccaaatttggctaaaattggcctaaaactggcaaacatttttccagtaacttttctttttttcaaatgaattttcttcatacttaaaaaagccctttgctaaaatataattttcaaaaaggtaaaattatgtctatggcactaatataaaatgagtagaagttaatgattttacttaactcatttttttctttctttctttttttttttttttttttgagacggagtcttgctctgtcacccaggctggagtacagcagagcgatctcggctcactgcaagctcctgcaagctccgcctcctggcttcacgccattctccccctcagcctcccgagtagctgggactacag

SEQ ID NO: 130058 - DNA, 3085 bp, Homo sapiens
  Payload ID: 5446
  Gene Symbol: EPHA3
  Gene Name: EPH receptor A3
  ENST ID: ENST00000494014
  CDS Start-End: 74-2830
agagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctgctccatcacctgtcctgacgattaagaaagatcggacctccagaaatagcatctctttgtcctggcaagaacctgaacatcctaatgggatcatattggactacgaggtcaaatactatgaaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactctttctccatctctggtgaaagtagccaagtggtcatgatcgccatttcagcggcagtagcaattattctcctcactgttgtcatctatgttttgattgggaggttctgtggctataagtcaaaacatggggcagatgaaaaaagacttcattttggcaatgggcatttaaaacttccaggtctcaggacttatgttgacccacatacatatgaagaccctacccaagctgttcatgagtttgccaaggaattggatgccaccaacatatccattgataaagttgttggagcaggtgaatttggagaggtgtgcagtggtcgcttaaaacttccttcaaaaaaagagatttcagtggccattaagaccctgaaagttggctacacagaaaagcagaggagagacttcctgggagaagcaagcattatgggacagtttgaccaccccaatatcattcgactggaaggagttgttaccaaaagtaagccagttatgattgtcacagaatacatggagaatggttccttggatagtttcctacgtaaacacgatgcccagtttactgtcattcagctagtggggatgcttcgagggatagcatctggcatgaagtacctgtcagacatgggctatgttcaccgagacctcgctgctcggaacatcttgatcaacagtaacttggtgtgtaaggtttctgatttcggactttcgcgtgtcctggaggatgacccagaagctgcttatacaacaagaggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaattaaagctgtagatgagggctatcgactgccaccccccatggactgcccagctgccttgtatcagctgatgctggactgctggcagaaagacaggaacaacagacccaagtttgagcagattgttagtattctggacaagcttatccggaatcccggcagcctgaagatcatcaccagtgcagccgcaaggccatcaaaccttcttctggaccaaagcaatgtggatatcactaccttccgcacaacagtgacatgaaaaaggttggtgtcaccgtggttgggccacagaagaagatcatcagtagcattaaagctctagaaacgcaatcaaagaatggcccagttcccgtgtaaagcacgggacggaagtgcttctggacggaagtggtggctgtggaaggcgtagcatcatcctgcagacagacaataattctggagatactggtggaagttccaagtccaataagacactcaaatatgagtacaaatgccttaaaatggaattgaaaaa

SEQ ID NO: 130059 - DNA, 6346 bp, Homo sapiens
  Payload ID: 5447
  Gene Symbol: EPHA4
  Gene Name: EPH receptor A4
  Uniprot ID: P54764
  ENST ID: ENST00000281821
  CDS Start-End: 43-3003
ctgggatagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaatatctgcagcgttgcttggtgcacagattgctgaaactgtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagaccatgcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaagggagtagattctgctatcttggcctcacagcccttcctgttgattacaaagcccgtggaagaaaacagaacacaccctcctcagttccgtctaaatgtgtttcttctgcttcaattacaccagttctggggcaaagacactgatgaaacaacacccatacctgaaaagaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtctgtatgcgtgcctgtctgtgtgcgggtgtgtgtatgtgcgtagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcagggtctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccctgc

SEQ ID NO: 130060 - DNA, 3454 bp, Homo sapiens
  Payload ID: 5447
  Gene Symbol: EPHA4
  Gene Name: EPH receptor A4
  ENST ID: ENST00000409854
  CDS Start-End: 36-2885
agaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggagtaagtactcaacgatgtaacacgaaaggggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaatatctgcagcgttgcttggtgcacagattgctgaaactgtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagac

SEQ ID NO: 130061 - DNA, 3363 bp, Homo sapiens
  Payload ID: 5447
  Gene Symbol: EPHA4
  Gene Name: EPH receptor A4
  Uniprot ID: P54764
  ENST ID: ENST00000409938
  CDS Start-End: 276-3236
acgcgtgctcatcttgtgtaaaagtaaaagttgctcatgtcattagctcggctctgagtttgcatgagaaaccagcgcagctctcgagccacgggagaaaacacgatctgctgcggagcccagtgacctgaaactgtagcagtgactcgagacctgtcctctcctcgacgtcgccctataaccctcccgctttatttaggatccgcttttccgagagcagccactcaggcaacccccggaagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaa

SEQ ID NO: 130062 - DNA, 545 bp, Homo sapiens
  Payload ID: 5447
  Gene Symbol: EPHA4
  Gene Name: EPH receptor A4
  ENST ID: ENST00000415749
  CDS Start-End: 53-169
atttattccactgggatagaagcggcaggagcagcgttggcaccggcgaaccatggctgggattttctatttcgccctattttcgtgtctcttcgggatttgcgacgctgtcacaggttccagggtataccccgcgaatgaagtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggat

SEQ ID NO: 130063 - DNA, 584 bp, Homo sapiens
  Payload ID: 5447
  Gene Symbol: EPHA4
  Gene Name: EPH receptor A4
  ENST ID: ENST00000443796
  CDS Start-End: 53-584
atttattccactgggatagaagcggcaggagcagcgttggcaccggcgaaccatggctgggattttctatttcgccctattttcgtgtctcttcgggatttgcgacgctgtcacaggttccagggtataccccgcgaatgaaggtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaat

SEQ ID NO: 130064 - DNA, 565 bp, Homo sapiens
  Payload ID: 5447
  Gene Symbol: EPHA4
  Gene Name: EPH receptor A4
  ENST ID: ENST00000441679
  CDS Start-End: 1-565
agtttcatggatctctttctagtactcatttcacttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagt

SEQ ID NO: 130065 - DNA, 617 bp, Homo sapiens
  Payload ID: 5447
  Gene Symbol: EPHA4
  Gene Name: EPH receptor A4
  ENST ID: ENST00000434266
  CDS Start-End: 343-617
agctcggctctgagtttgcatgagaaaccagcgcagctctcgagccacgggagaaaacacgatctgctgcggagcccagtgacctgaaactgtagcagtgactcgagacctgtcctctcctcgacgtcgccctataaccctcccgctttatttaggatccgcttttccgagagcagccactcaggcaacccccggaaggtttgttaggagtttctccttgaaacgctttccgattccatcttttgaaatccagcaggcgagagtcacgacagactccaggacctcttgagcgctgtccgcagccccacgaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgaga

SEQ ID NO: 130066 - DNA, 492 bp, Homo sapiens
  Payload ID: 5447
  Gene Symbol: EPHA4
  Gene Name: EPH receptor A4
  ENST ID: ENST00000424339
  CDS Start-End: 1-114
gcctatcgtaaattcacatcagcaagtgatgtatggagctatggaatcgttatgtgggaagtgatgtcgtacggggagaggccctattgggatatgtccaatcaagatacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatg

SEQ ID NO: 130067 - DNA, 552 bp, Homo sapiens
  Payload ID: 5447
  Gene Symbol: EPHA4
  Gene Name: EPH receptor A4
  ENST ID: ENST00000419964
  CDS Start-End: 173-552
aaaattcaagccagtgatttcctacgggtggaagacgagtctctgattgtcccccaacacatcttgagaaagagagaatactttcgttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttca

SEQ ID NO: 130068 - DNA, 558 bp, Homo sapiens
  Payload ID: 5447
  Gene Symbol: EPHA4
  Gene Name: EPH receptor A4
  ENST ID: ENST00000541600
  CDS Start-End: 111-558
accggccgggcccgcccccttggcaatgtcttcagcccgctgctctcctaacttaagcatttattccactgggatagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctg

SEQ ID NO: 130069 - DNA, 8266 bp, Homo sapiens
  Payload ID: 5448
  Gene Symbol: EPHA5
  Gene Name: EPH receptor A5
  Uniprot ID: P54756
  ENST ID: ENST00000273854
  CDS Start-End: 602-3715
tccctcccctcttcagcactcagcccgcagctatttccttctgccagtctctttgaactctggatctttgcttttgctcgctgctctcctgtttttcattctccacattttctcaagtcctctttctttatccttagccaccctgcttttttcctccttttttaaaaaatcggagatttcgtcttaaaatgatttgccttccttaccttcgtccatttcaacactgaaggctgcaaagaaccttcacctttcccctagtggtatttaaaaattctcaatccgtaaaaagtctttttgaaaggcaaaggaacaggacccaggaccctctcgacacccttgatccgagtccagatctgcactagcaaccagaactaatatttcatttaaccccaccaaagggggaggcgagaggagccagaagcaaacttcagctgtctcagccggatccgtggttcctacatttggaggagccgcgtgccagaaggcgtaggaccccaaggggggacaaggaggactcccgagtctcccttcgccgctctgcgaggccgaagcggtggactgagccgctcgggacagcggcaccggaggaggctcggagaagatgcggggctcggggccccggggtgcgggacgccggcggcccccaagcggcggcggcgacacccccatcaccccagcgtccctggccggctgctactctgcacctcgacgggctcccctctggacgtgccttctcctgtgcgccgcactccggaccctcctggccagccccagcaacgaagtgaatttattggattcacgcactgtcatgggggacctgggatggattgcttttccaaaaaatgggtgggaagagattggtgaagtggatgaaaattatgcccctatccacacataccaagtatgcaaagtgatggaacagaatcagaataactggcttttgaccagttggatctccaatgaaggtgcttccagaatcttcatagaactcaaatttaccctgcgggactgcaacagccttcctggaggactggggacctgtaaggaaacctttaatatgtattactttgagtcagatgatcagaatgggagaaacatcaaggaaaaccaatacatcaaaattgataccattgctgccgatgaaagctttacagaacttgatcttggtgaccgtgttatgaaactgaatacagaggtcagagatgtaggacctctaagcaaaaagggattttatcttgcttttcaagatgttggtgcttgcattgctctggtttctgtgcgtgtatactataaaaaatgcccttctgtggtacgacacttggctgtcttccctgacaccatcactggagctgattcttcccaattgctcgaagtgtcaggctcctgtgtcaaccattctgtgaccgatgaacctcccaaaatgcactgcagcgccgaaggggagtggctggtgcccatcgggaaatgcatgtgcaaggcaggatatgaagagaaaaatggcacctgtcaagtgtgcagacctgggttcttcaaagcctcacctcacatccagagctgcggcaaatgtccacctcacagttatacccatgaggaagcttcaacctcttgtgtctgtgaaaaggattatttcaggagagagtctgatccacccacaatggcatgcacaagacccccctctgctcctcggaatgccatctcaaatgttaatgaaactagtgtctttctggaatggattccgcctgctgacactggtggaaggaaagacgtgtcatattatattgcatgcaagaagtgcaactcccatgcaggtgtgtgtgaggagtgtggcggtcatgtcaggtaccttccccggcaaagcggcctgaaaaacacctctgtcatgatggtggatctactcgctcacacaaactatacctttgagattgaggcagtgaatggagtgtccgacttgagcccaggagcccggcagtatgtgtctgtaaatgtaaccacaaatcaagcagctccatctccagtcaccaatgtgaaaaaagggaaaattgcaaaaaacagcatctctttgtcttggcaagaaccagatcgtcccaatggaatcatcctagagtatgaaatcaagtattttgaaaaggaccaagagaccagctacacgattatcaaatctaaagagacaactattactgcagagggcttgaaaccagcttcagtttatgtcttccaaattcgagcacgtacagcagcaggctatggtgtcttcagtcgaagatttgagtttgaaaccaccccagtgtttgcagcatccagcgatcaaagccagattcctgtaattgctgtgtctgtgacagtgggagtcattttgttggcagtggttatcggcgtcctcctcagtggaagttgctgcgaatgtggctgtgggagggcttcttccctgtgcgctgttgcccatccaagcctaatatggcggtgtggctacagcaaagcaaaacaagatccagaagaggaaaagatgcattttcataatgggcacattaaactgccaggagtaagaacttacattgatccacatacctatgaggatcccaatcaagctgtccacgaatttgctaaggagatagaagcatcatgtatcaccattgagagagttattggagcaggtgaatttggtgaagtttgtagtggacgtttgaaactaccaggaaaaagagaattacctgtggctatcaaaacccttaaagtaggctatactgaaaagcaacgcagagatttcctaggtgaagcaagtatcatgggacagtttgatcatcctaacatcatccatttagaaggtgtggtgaccaaaagtaaaccagtgatgatcgtgacagagtatatggagaatggctctttagatacatttttgaagaaaaacgatgggcagttcactgtgattcagcttgttggcatgctgagaggtatctctgcaggaatgaagtacctttctgacatgggctatgtgcatagagatcttgctgccagaaacatcttaatcaacagtaaccttgtgtgcaaagtgtctgactttggactttcccgggtactggaagatgatcccgaggcagcctacaccacaaggggaggaaaaattccaatcagatggactgccccagaagcaatagctttccgaaagtttacttctgccagtgatgtctggagttatggaatagtaatgtgggaagttgtgtcttatggagagagaccctactgggagatgaccaatcaagatgtgattaaagcggtagaggaaggctatcgtctgccaagccccatggattgtcctgctgctctctatcagttaatgctggattgctggcagaaagagcgaaatagcaggcccaagtttgatgaaatagtcaacatgttggacaagctgatacgtaacccaagtagtctgaagacgctggttaatgcatcctgcagagtatctaatttattggcagaacatagcccactaggatctggggcctacagatcagtaggtgaatggctagaggcaatcaagatgggccggtatacagagattttcatggaaaatggatacagttcaatggacgctgtggctcaggtgaccttggaggatttgagacggcttggagtgactcttgtcggtcaccagaagaagatcatgaacagccttcaagaaatgaaggtgcagctggtaaacggaatggtgccattgtaacttcatgtaaatgtcgcttcttcaagtgaatgattctgcactttgtaaacagcactgagatttattttaacaaaaaaagggggaaaagggaaaacagtgatttctaaaccttagaaaacatttgcctcagccacagaatttgtaatcatggttttactgaagtatccagttcttagtccttagtcttcatttttcatgaagcaaacatatcttgcattaaaagggacatgaagttagacatcatcttaagttacaacaacagaatccttcccactacttctacaaaattttgtacatgaaatatataattatatagcacttttatagactgaattaaggcaacccctttcaaaacttccagggatctacttgaaaggaaatgttttatagccatttgtgagctaacaaaagctacagtttactgaagtttacttcaagtcttaattgtctacaaaagtgtattgaagagcaatatgattagattatttcttaatagatatcttcttttgtaattttaaaatgctgttacacagcgttaagttatagaaactagtgtgtaaacatgttgcttgatcaagaaaaagtacaatacagggtgtatatttattttttgtgttataaagtttacttttagttgctcttctagagattattaggtaataaatgtgtatatactgtataatttgcaatatacccaggaactgatttaagatggaattgtgtgtgtgtttgcttgcacatgtgtgtgttaccattctgcttgcatttctaatagtgtttcaattttagcaacatataggagcaagtgttccagaatgtaatatgaataggagaaatagggaagcagtaaaacaaaatttaacacaagcttgtgtctcttttcctctcatgtgtccaaaagctaatctctttattcactaaaaggaaatgtgtataagactaaatcccctttggctttttaaaaacattttgtgatatcagtgacaatgcagttcttctagccattaatcttgtacccctgtaagaaatttcacctttctgagtcctgaaaagtatcttgtcaagcaaagttgacaccgaagggcacattttcagcaggatgtagaaggatttaactgtgcaggcttctgttaatgttgttaaatccaggcacatagcacgaagcatcacccttaagtgttaatccgttgtaaccattcccattttgactcagttctagaaattttgactctaaggcagcaatggaattatgacaaatatatatatatacacatacacacacacaaatatatatatatgcttatttcccttcagaattttatttcaataattgataagttttatttttaatggatgtttattcatttgttaatttcagtttgtattcagttacatggctttgagtttattttattgaaccaatccaaggtattatgtaattaggcttattaaggaatataacatatcttctatgtatgctctatataccacacatgatgaagacttatatttgtgatacaaattatgcagtgtattagaaattgtccaaaactgagctcctgagataaccaacatttttgtattattacactttataaaaattatggaatgtcatgtgattagtcaaaatcagagcatttaaataaaatacagcctactcatgattatcaatgttaatagtacagtagatcagagaagcctggattaatgaaatttatcagaaatatagccacgttatattaatggtattcttttttccaagcacttgttttatttgaatattagcacatataagaataaacttttgggaaataactacttcctattctgcccaccctttacttaagcagtaaagtacctcttttctaaagaaccaggaaacatcaaaataaccacaacaaaaatctaaacagttttcaaataatacattcagttctcataataataagggctatataccatgggtccacacaaactgtgctgcaaacatataatctattagtttagtaaaatttccagagatgtgaatttaatattttcttgataaaatcataaaaaagcatcaccattattaaagatgcatttgttcatttcaataaacagaaattaatgaaacaaattacttttgtacaaaataaatgatgattatgtggcactttattgaattttatagaaatattccaatctaagtgataaagtaacaactgagaaacttcagaatgaaagccttattgattcaaaaggaaaattaccatatgctttagggctgatgaacttgccacaattgcttagacataacaaagatattttctacattgttttccaactttatatgctgaaagataattaggaggtccgggtggagtgtatctaaatgactagaactttaagttgcaatatagattttctctttttaacaaaggaagaatataaattaatttggatcaaatttatttgccttctttgcaatcttggtgatcattttggaaagtaaattgaaaggaaagttaaatagccacatagttttcttttgcatctcaatttggttgagaatttctaaggaaggttaatatgactttagaatgaataaagagactgtcaaacaacaagtactctccctaaaaaagaggaaagaatgccttcctaaaatatttgtttcctattgtatatgtcaccaattggaaaatgccaatctcatctgcaagtgtgagaaatggaacaaggagaggagccaactctagtaaaatgtagtgaggccataatccaaggcaaagtttaacaaatcttgattgtgtaatttcttattctgttgattcattttgtcacccaccagactaccaaaaataaagcacagacatgacaattttagtatatacaacagatttggcaaataatacataatcttattgtaattgccagtagcaatatcttaaggggcatgagtctttcacagtattggactttgaaaaattggtacagggagtaattttcaacagactgatacttgaagtcactcaattactactttgacctatcataatttgtttctaatcttgtcatttgctcatatatactattaatataaccagttgctcttttcataatgtactatttctatgtaaagatgtaaagattttgattttcctatgttttaaaattgtaatgtgcatgatcttttatttcttgtgtttcaattaccaagtcagtattctaaggttgtaagattactgtaaaaattatattccaatattttatctaaacttaagtgtggccagcattattggtttcagagttgcctaaacaacacagaatatccttaattcagtttgtaaaagagttttgaccagtgtaaaaaagtgaagacacagtttcatgtttcaagtttaaaatggaaagttaatatcatttgagcacttatgtgttttcatgtcttctacttaatctgtatgtgaaagtaaaatatttttaacaccattatttatgccatgtaaagtgggttctcagaagcacaagcacagatatttaccttctgaagacatttttggctataaaagtgcattggatggcaaacactatttgagtcaggtgttagaaatttattagatgtattatattacatagtagaataaggtccctttctcattttgtttttcctaaaaataagaaaaaaaagaagtgtgatagtaaactgtctttgctaatgtcctgccagatgtttaacttcaaattaagcaaaaagtaggtacaatatgatgatgatcctgatgatgatgatgatgatgatgatgaagaataaatggaatcaaaatgctagctttatttgacattaataagtaaaataagtcatcattttttcaactctgtagcacagctgtttacattgaataattttctctattgtgctgttaattatatagtaatgtatcaaaatagaaataggaactttcttttcatttcttattcatttatgaagaaatcttttcacacataaatgattgaatgttcttgttcagaatgaccacataatcattgcttagaagaagataccaattcttttaaaagaaaaaaagtctgtttataataatcagaatcaaatgttgtttgtttcttctaaacgttaatggagaaaattgaaggtggtaaaatgtcatgtttattcaggctgggaactgtattcacagtagaagtttcagtggtcaacatatctatgactctttaggctgctgtagttttacagtcaattatttaaaagtgagtagttacatttataagagcctgagaatacttagactcagtcatttgttagtatttttaccaaaatctcttagtttcagacatgtcagaagcagctatatagcatatcttattctatgatatacatcaggctatctcaagttcctgtctcacagttaattcaaagaaggattaggatttctgtattttttctcatttgaatctttatgtgcatttggtttgtgtacatgctttttgtagtgtaagatatgaaattttatattttttcagaaaataaaaaccctttgaatacagtta

SEQ ID NO: 130070 - DNA, 3427 bp, Homo sapiens
  Payload ID: 5448
  Gene Symbol: EPHA5
  Gene Name: EPH receptor A5
  Uniprot ID: P54756
  ENST ID: ENST00000354839
  CDS Start-End: 194-3241
gaggagccagaagcaaacttcagctgtctcagccggatccgtggttcctacatttggaggagccgcgtgccagaaggcgtaggaccccaaggggggacaaggaggactcccgagtctcccttcgccgctctgcgaggccgaagcggtggactgagccgctcgggacagcggcaccggaggaggctcggagaagatgcggggctcggggccccggggtgcgggacgccggcggcccccaagcggcggcggcgacacccccatcaccccagcgtccctggccggctgctactctgcacctcgacgggctcccctctggacgtgccttctcctgtgcgccgcactccggaccctcctggccagccccagcaacgaagtgaatttattggattcacgcactgtcatgggggacctgggatggattgcttttccaaaaaatgggtgggaagagattggtgaagtggatgaaaattatgcccctatccacacataccaagtatgcaaagtgatggaacagaatcagaataactggcttttgaccagttggatctccaatgaaggtgcttccagaatcttcatagaactcaaatttaccctgcgggactgcaacagccttcctggaggactggggacctgtaaggaaacctttaatatgtattactttgagtcagatgatcagaatgggagaaacatcaaggaaaaccaatacatcaaaattgataccattgctgccgatgaaagctttacagaacttgatcttggtgaccgtgttatgaaactgaatacagaggtcagagatgtaggacctctaagcaaaaagggattttatcttgcttttcaagatgttggtgcttgcattgctctggtttctgtgcgtgtatactataaaaaatgcccttctgtggtacgacacttggctgtcttccctgacaccatcactggagctgattcttcccaattgctcgaagtgtcaggctcctgtgtcaaccattctgtgaccgatgaacctcccaaaatgcactgcagcgccgaaggggagtggctggtgcccatcgggaaatgcatgtgcaaggcaggatatgaagagaaaaatggcacctgtcaagtgtgcagacctgggttcttcaaagcctcacctcacatccagagctgcggcaaatgtccacctcacagttatacccatgaggaagcttcaacctcttgtgtctgtgaaaaggattatttcaggagagagtctgatccacccacaatggcatgcacaagacccccctctgctcctcggaatgccatctcaaatgttaatgaaactagtgtctttctggaatggattccgcctgctgacactggtggaaggaaagacgtgtcatattatattgcatgcaagaagtgcaactcccatgcaggtgtgtgtgaggagtgtggcggtcatgtcaggtaccttccccggcaaagcggcctgaaaaacacctctgtcatgatggtggatctactcgctcacacaaactatacctttgagattgaggcagtgaatggagtgtccgacttgagcccaggagcccggcagtatgtgtctgtaaatgtaaccacaaatcaagcagctccatctccagtcaccaatgtgaaaaaagggaaaattgcaaaaaacagcatctctttgtcttggcaagaaccagatcgtcccaatggaatcatcctagagtatgaaatcaagtattttgaaaaggaccaagagaccagctacacgattatcaaatctaaagagacaactattactgcagagggcttgaaaccagcttcagtttatgtcttccaaattcgagcacgtacagcagcaggctatggtgtcttcagtcgaagatttgagtttgaaaccaccccagtgtttgcagcatccagcgatcaaagccagattcctgtaattgctgtgtctgtgacagtgggagtcattttgttggcagtggttatcggcgtcctcctcagtggaaggcggtgtggctacagcaaagcaaaacaagatccagaagaggaaaagatgcattttcataatgggcacattaaactgccaggagtaagaacttacattgatccacatacctatgaggatcccaatcaagctgtccacgaatttgctaaggagatagaagcatcatgtatcaccattgagagagttattggagcaggtgaatttggtgaagtttgtagtggacgtttgaaactaccaggaaaaagagaattacctgtggctatcaaaacccttaaagtaggctatactgaaaagcaacgcagagatttcctaggtgaagcaagtatcatgggacagtttgatcatcctaacatcatccatttagaaggtgtggtgaccaaaagtaaaccagtgatgatcgtgacagagtatatggagaatggctctttagatacatttttgaagaaaaacgatgggcagttcactgtgattcagcttgttggcatgctgagaggtatctctgcaggaatgaagtacctttctgacatgggctatgtgcatagagatcttgctgccagaaacatcttaatcaacagtaaccttgtgtgcaaagtgtctgactttggactttcccgggtactggaagatgatcccgaggcagcctacaccacaaggggaggaaaaattccaatcagatggactgccccagaagcaatagctttccgaaagtttacttctgccagtgatgtctggagttatggaatagtaatgtgggaagttgtgtcttatggagagagaccctactgggagatgaccaatcaagatgtgattaaagcggtagaggaaggctatcgtctgccaagccccatggattgtcctgctgctctctatcagttaatgctggattgctggcagaaagagcgaaatagcaggcccaagtttgatgaaatagtcaacatgttggacaagctgatacgtaacccaagtagtctgaagacgctggttaatgcatcctgcagagtatctaatttattggcagaacatagcccactaggatctggggcctacagatcagtaggtgaatggctagaggcaatcaagatgggccggtatacagagattttcatggaaaatggatacagttcaatggacgctgtggctcaggtgaccttggaggatttgagacggcttggagtgactcttgtcggtcaccagaagaagatcatgaacagccttcaagaaatgaaggtgcagctggtaaacggaatggtgccattgtaacttcatgtaaatgtcgcttcttcaagtgaatgattctgcactttgtaaacagcactgagatttattttaacaaaaaaagggggaaaagggaaaacagtgatttctaaaccttagaaaacatttgcctcagccacagaatttgtaatcatggttttactgaagtatccagttcttagtccttagtct

SEQ ID NO: 130071 - DNA, 3662 bp, Homo sapiens
  Payload ID: 5448
  Gene Symbol: EPHA5
  Gene Name: EPH receptor A5
  ENST ID: ENST00000432638
  CDS Start-End: 319-2943
aaaaagtctttttgaaaggcaaaggaacaggacccaggaccctctcgacacccttgatccgagtccagatctgcactagcaaccagaactaatatttcatttaaccccaccaaagggggaggcgagaggagccagaagcaaacttcagctgtctcagccggatccgtggttcctacatttggaggagccgcgtgccagaaggcgtaggaccccaaggggggacaaggaggactcccgagtctcccttcgccgctctgcgaggccgaagcggtggactgagccgctcgggacagcggcaccggaggaggctcggagaagatgcggggctcggggccccggggtgcgggacgccggcggcccccaagcggcggcggcgacacccccatcaccccagcgtccctggccggctgctactctgcacctcgacgggctcccctctggacgtgccttctcctgtgcgccgcactccggaccctcctggccagccccagcaacgaagtgaatttattggattcacgcactgtcatgggggacctgggatggattgcttttccaaaaaatgggtgggaagagattggtgaagtggatgaaaattatgcccctatccacacataccaagtatgcaaagtgatggaacagaatcagaataactggcttttgaccagttggatctccaatgaaggtgcttccagaatcttcatagaactcaaatttaccctgcgggactgcaacagccttcctggaggactggggacctgtaaggaaacctttaatatgtattactttgagtcagatgatcagaatgggagaaacatcaaggaaaaccaatacatcaaaattgataccattgctgccgatgaaagctttacagaacttgatcttggtgaccgtgttatgaaactgaatacagaggtcagagatgtaggacctctaagcaaaaagggattttatcttgcttttcaagatgttggtgcttgcattgctctggtttctgtgcgtgtatactataaaaaatgcccttctgtggtacgacacttggctgtcttccctgacaccatcactggagctgattcttcccaattgctcgaagtgtcaggctcctgtgtcaaccattctgtgaccgatgaacctcccaaaatgcactgcagcgccgaaggggagtggctggtgcccatcgggaaatgcatgtgcaaggcaggatatgaagagaaaaatggcacctgtcaagctccatctccagtcaccaatgtgaaaaaagggaaaattgcaaaaaacagcatctctttgtcttggcaagaaccagatcgtcccaatggaatcatcctagagtatgaaatcaagtattttgaaaaggaccaagagaccagctacacgattatcaaatctaaagagacaactattactgcagagggcttgaaaccagcttcagtttatgtcttccaaattcgagcacgtacagcagcaggctatggtgtcttcagtcgaagatttgagtttgaaaccaccccagtgtcagttgcagcatccagcgatcaaagccagattcctgtaattgctgtgtctgtgacagtgggagtcattttgttggcagtggttatcggcgtcctcctcagtggaagttgctgcgaatgtggctgtgggagggcttcttccctgtgcgctgttgcccatccaagcctaatatggcggtgtggctacagcaaagcaaaacaagatccagaagaggaaaagatgcattttcataatgggcacattaaactgccaggagtaagaacttacattgatccacatacctatgaggatcccaatcaagctgtccacgaatttgctaaggagatagaagcatcatgtatcaccattgagagagttattggagcaggtgaatttggtgaagtttgtagtggacgtttgaaactaccaggaaaaagagaattacctgtggctatcaaaacccttaaagtaggctatactgaaaagcaacgcagagatttcctaggtgaagcaagtatcatgggacagtttgatcatcctaacatcatccatttagaaggtgtggtgaccaaaagtaaaccagtgatgatcgtgacagagtatatggagaatggctctttagatacatttttgaagaaaaacgatgggcagttcactgtgattcagcttgttggcatgctgagaggtatctctgcaggaatgaagtacctttctgacatgggctatgtgcatagagatcttgctgccagaaacatcttaatcaacagtaaccttgtgtgcaaagtgtctgactttggactttcccgggtactggaagatgatcccgaggcagcctacaccacaaggggaggaaaaattccaatcagatggactgccccagaagcaatagctttccgaaagtttacttctgccagtgatgtctggagttatggaatagtaatgtgggaagttgtgtcttatggagagagaccctactgggagatgaccaatcaagatgtgattaaagcggtagaggaaggctatcgtctgccaagccccatggattgtcctgctgctctctatcagttaatgctggattgctggcagaaagagcgaaatagcaggcccaagtttgatgaaatagtcaacatgttggacaagctgatacgtaacccaagtagtctgaagacgctggttaatgcatcctgcagagtatctaatttattggcagaacatagcccactaggatctggggcctacagatcagtaggtgaatggctagaggcaatcaagatgggccggtatacagagattttcatggaaaatggatacagttcaatggacgctgtggctcaggtgaccttggaggatttgagacggcttggagtgactcttgtcggtcaccagaagaagatcatgaacagccttcaagaaatgaaggtgcagctggtaaacggaatggtgccattgtaacttcatgtaaatgtcgcttcttcaagtgaatgattctgcactttgtaaacagcactgagatttattttaacaaaaaaagggggaaaagggaaaacagtgatttctaaaccttagaaaacatttgcctcagccacagaatttgtaatcatggttttactgaagtatccagttcttagtccttagtcttcatttttcatgaagcaaacatatcttgcattaaaagggacatgaagttagacatcatcttaagttacaacaacagaatccttcccactacttctacaaaattttgtacatgaaatatataattatatagcacttttatagactgaattaaggcaacccctttcaaaacttccagggatctacttgaaaggaaatgttttatagccatttgtgagctaacaaaagctacagtttactgaagtttacttcaagtcttaattgtctacaaaagtgtattgaagagcaatatgattagattatttcttaatagatatcttcttttgtaattttaaaatgctgttacacagcgttaagttatagaaactagtgtgtaaacatgttgcttgatcaagaaaaagtacaatacagggtgtatatttattttttgtgttataaagtttacttttagttgctcttctagagattattaggtaataaatgtgtatatactgtataatttgcaatatacccaggaactgatttaagatggaatt

SEQ ID NO: 130072 - DNA, 5176 bp, Homo sapiens
  Payload ID: 5448
  Gene Symbol: EPHA5
  Gene Name: EPH receptor A5
  ENST ID: ENST00000511294
  CDS Start-End: 754-3768
ccagacacagcaggagcgcgccttggcggtgcagtttcaacctcgacttcgcagccgcgcacacaccgcctgctccccgagcagcgggaaccgcagcagctcctgggccgccgcagcgcagctccgcgctcctaccggccggcagccgtcagtccctcccctcttcagcactcagcccgcagctatttccttctgccagtctctttgaactctggatctttgcttttgctcgctgctctcctgtttttcattctccacattttctcaagtcctctttctttatccttagccaccctgcttttttcctccttttttaaaaaatcggagatttcgtcttaaaatgatttgccttccttaccttcgtccatttcaacactgaaggctgcaaagaaccttcacctttcccctagtggtatttaaaaattctcaatccgtaaaaagtctttttgaaaggcaaaggaacaggacccaggaccctctcgacacccttgatccgagtccagatctgcactagcaaccagaactaatatttcatttaaccccaccaaagggggaggcgagaggagccagaagcaaacttcagctgtctcagccggatccgtggttcctacatttggaggagccgcgtgccagaaggcgtaggaccccaaggggggacaaggaggactcccgagtctcccttcgccgctctgcgaggccgaagcggtggactgagccgctcgggacagcggcaccggaggaggctcggagaagatgcggggctcggggccccggggtgcgggacgccggcggcccccaagcggcggcggcgacacccccatcaccccagcgtccctggccggctgctactctgcacctcgacgggctcccctctggacgtgccttctcctgtgcgccgcactccggaccctcctggccagccccagcaacgaagtgaatttattggattcacgcactgtcatgggggacctgggatggattgcttttccaaaaaatgggtgggaagagattggtgaagtggatgaaaattatgcccctatccacacataccaagtatgcaaagtgatggaacagaatcagaataactggcttttgaccagttggatctccaatgaaggtgcttccagaatcttcatagaactcaaatttaccctgcgggactgcaacagccttcctggaggactggggacctgtaaggaaacctttaatatgtattactttgagtcagatgatcagaatgggagaaacatcaaggaaaaccaatacatcaaaattgataccattgctgccgatgaaagctttacagaacttgatcttggtgaccgtgttatgaaactgaatacagaggtcagagatgtaggacctctaagcaaaaagggattttatcttgcttttcaagatgttggtgcttgcattgctctggtttctgtgcgtgtatactataaaaaatgcccttctgtggtacgacacttggctgtcttccctgacaccatcactggagctgattcttcccaattgctcgaagtgtcaggctcctgtgtcaaccattctgtgaccgatgaacctcccaaaatgcactgcagcgccgaaggggagtggctggtgcccatcgggaaatgcatgtgcaaggcaggatatgaagagaaaaatggcacctgtcaagtgtgcagacctgggttcttcaaagcctcacctcacatccagagctgcggcaaatgtccacctcacagttatacccatgaggaagcttcaacctcttgtgtctgtgaaaaggattatttcaggagagagtctgatccacccacaatggcatgcacaagacccccctctgctcctcggaatgccatctcaaatgttaatgaaactagtgtctttctggaatggattccgcctgctgacactggtggaaggaaagacgtgtcatattatattgcatgcaagaagtgcaactcccatgcaggtgtgtgtgaggagtgtggcggtcatgtcaggtaccttccccggcaaagcggcctgaaaaacacctctgtcatgatggtggatctactcgctcacacaaactatacctttgagattgaggcagtgaatggagtgtccgacttgagcccaggagcccggcagtatgtgtctgtaaatgtaaccacaaatcaagcagctccatctccagtcaccaatgtgaaaaaagggaaaattgcaaaaaacagcatctctttgtcttggcaagaaccagatcgtcccaatggaatcatcctagagtatgaaatcaagtattttgaaaaggaccaagagaccagctacacgattatcaaatctaaagagacaactattactgcagagggcttgaaaccagcttcagtttatgtcttccaaattcgagcacgtacagcagcaggctatggtgtcttcagtcgaagatttgagtttgaaaccaccccagtgtcagttgcagcatccagcgatcaaagccagattcctgtaattgctgtgtctgtgacagtgggagtcattttgttggcagtggttatcggcgtcctcctcagtggaagttgctgcgaatgtggctgtgggagggcttcttccctgtgcgctgttgcccatccaagcctaatatggcggtgtggctacagcaaagcaaaacaagatccagaagaggaaaagatgcattttcataatgggcacattaaactgccaggagtaagaacttacattgatccacatacctatgaggatcccaatcaagctgtccacgaatttgctaaggagatagaagcatcatgtatcaccattgagagagttattggagcaggtgaatttggtgaagtttgtagtggacgtttgaaactaccaggaaaaagagaattacctgtggctatcaaaacccttaaagtaggctatactgaaaagcaacgcagagatttcctaggtgaagcaagtatcatgggacagtttgatcatcctaacatcatccatttagaaggtgtggtgaccaaaagtaaaccagtgatgatcgtgacagagtatatggagaatggctctttagatacatttttgaagaaaaacgatgggcagttcactgtgattcagcttgttggcatgctgagaggtatctctgcaggaatgaagtacctttctgacatgggctatgtgcatagagatcttgctgccagaaacatcttaatcaacagtaaccttgtgtgcaaagtgtctgactttggactttcccgggtactggaagatgatcccgaggcagcctacaccacaaggggaggaaaaattccaatcagatggactgccccagaagcaatagctttccgaaagtttacttctgccagtgatgtctggagttatggaatagtaatgtgggaagttgtgtcttatggagagagaccctactgggagatgaccaatcaagatgtgattaaagcggtagaggaaggctatcgtctgccaagccccatggattgtcctgctgctctctatcagttaatgctggattgctggcagaaagagcgaaatagcaggcccaagtttgatgaaatagtcaacatgttggacaagctgatacgtaacccaagtagtctgaagacgctggttaatgcatcctgcagagtatctaatttattggcagaacatagcccactaggatctggggcctacagatcagtaggtgaatggctagaggcaatcaagatgggccggtatacagagattttcatggaaaatggatacagttcaatggacgctgtggctcaggtgaccttggagtgagtaatttttctgataatttttacataattgctggggcaagaaaaattgttcaaaaaccaatctggatgaggtaagggaaatcagttaacctttgcggatgtgtggcagctctcaaagaagcctcatcatctttagcctgtattgttaacaactgcatggttaatgctacatgtggccagtatctttgcttctttgcttcaaacaaataacattggcatacttgaataattggaataacagctccttggcaaaatactggtgttttgtgttgtggaaaagatgttttcttgacaagtttttttatactggtatctatgttatatgaatgtaaatacaaaacaaaataaactgtaagcacaattggtgtggctagtcctacataaggaccaaacatatttgtacattttggctctctacgatgaatatcaaggtaacagtagcttaaacaaagcttccctggcaggatctcatttaatttctaaatggtgcaccttacattctttcaatctaaggatgtatcagatcccgcctctgatttgttatttggtacaatctcagtggaaccaattgtgcccttttctgtttgcacgtttaagataaaatttatcaaaccttattaaataaaaatcactagagttaaatattaagttctttaaggttgtaagttgtttgtattttattatatactctgtacatgtggttgttttagcctaattgttatttgtgaaaattaactgtctttatggtggttccatctagattacattaacattaatgttttaacctgtgaatataatgataacttacttcaaattacctgccaattcaaaggttaaaatattgtaaggtttagaaaatggtagaatattctgaagcactaaaccatagttgttattttatttgtacacatgatatgaacattgagcagttcttgctcacccatctctattattctgacattctttgattcattgaattcattgttcctccccacagaaggtaacagggtaccaccatttatcaccaattaatgtcacattctcagcattctcttccttcataccgataactaaaaggacctgaaaccaaccactcagcttgctttctaaatttactgaatctcattctcacggtccaccagatcatatctacttgataacacatatgctttgtccattatttctttggacactcaaggaacccatttgtgctatatttaaactggtatactgaaaaatttactgataatttaaaactatttttacatgattgctatttaatttttcagtaaaaatggtcattttaatttattaaagtcatttgtcattttatattaaaatgatattgtaggtatttcttctacccaatgtcagattacttgtaaatatataataaaattatttgcatt

SEQ ID NO: 130073 - DNA, 8355 bp, Homo sapiens
  Payload ID: 5448
  Gene Symbol: EPHA5
  Gene Name: EPH receptor A5
  ENST ID: ENST00000613740
  CDS Start-End: 754-3804
ccagacacagcaggagcgcgccttggcggtgcagtttcaacctcgacttcgcagccgcgcacacaccgcctgctccccgagcagcgggaaccgcagcagctcctgggccgccgcagcgcagctccgcgctcctaccggccggcagccgtcagtccctcccctcttcagcactcagcccgcagctatttccttctgccagtctctttgaactctggatctttgcttttgctcgctgctctcctgtttttcattctccacattttctcaagtcctctttctttatccttagccaccctgcttttttcctccttttttaaaaaatcggagatttcgtcttaaaatgatttgccttccttaccttcgtccatttcaacactgaaggctgcaaagaaccttcacctttcccctagtggtatttaaaaattctcaatccgtaaaaagtctttttgaaaggcaaaggaacaggacccaggaccctctcgacacccttgatccgagtccagatctgcactagcaaccagaactaatatttcatttaaccccaccaaagggggaggcgagaggagccagaagcaaacttcagctgtctcagccggatccgtggttcctacatttggaggagccgcgtgccagaaggcgtaggaccccaaggggggacaaggaggactcccgagtctcccttcgccgctctgcgaggccgaagcggtggactgagccgctcgggacagcggcaccggaggaggctcggagaagatgcggggctcggggccccggggtgcgggacgccggcggcccccaagcggcggcggcgacacccccatcaccccagcgtccctggccggctgctactctgcacctcgacgggctcccctctggacgtgccttctcctgtgcgccgcactccggaccctcctggccagccccagcaacgaagtgaatttattggattcacgcactgtcatgggggacctgggatggattgcttttccaaaaaatgggtgggaagagattggtgaagtggatgaaaattatgcccctatccacacataccaagtatgcaaagtgatggaacagaatcagaataactggcttttgaccagttggatctccaatgaaggtgcttccagaatcttcatagaactcaaatttaccctgcgggactgcaacagccttcctggaggactggggacctgtaaggaaacctttaatatgtattactttgagtcagatgatcagaatgggagaaacatcaaggaaaaccaatacatcaaaattgataccattgctgccgatgaaagctttacagaacttgatcttggtgaccgtgttatgaaactgaatacagaggtcagagatgtaggacctctaagcaaaaagggattttatcttgcttttcaagatgttggtgcttgcattgctctggtttctgtgcgtgtatactataaaaaatgcccttctgtggtacgacacttggctgtcttccctgacaccatcactggagctgattcttcccaattgctcgaagtgtcaggctcctgtgtcaaccattctgtgaccgatgaacctcccaaaatgcactgcagcgccgaaggggagtggctggtgcccatcgggaaatgcatgtgcaaggcaggatatgaagagaaaaatggcacctgtcaagtgtgcagacctgggttcttcaaagcctcacctcacatccagagctgcggcaaatgtccacctcacagttatacccatgaggaagcttcaacctcttgtgtctgtgaaaaggattatttcaggagagagtctgatccacccacaatggcatgcacaagacccccctctgctcctcggaatgccatctcaaatgttaatgaaactagtgtctttctggaatggattccgcctgctgacactggtggaaggaaagacgtgtcatattatattgcatgcaagaagtgcaactcccatgcaggtgtgtgtgaggagtgtggcggtcatgtcaggtaccttccccggcaaagcggcctgaaaaacacctctgtcatgatggtggatctactcgctcacacaaactatacctttgagattgaggcagtgaatggagtgtccgacttgagcccaggagcccggcagtatgtgtctgtaaatgtaaccacaaatcaagcagctccatctccagtcaccaatgtgaaaaaagggaaaattgcaaaaaacagcatctctttgtcttggcaagaaccagatcgtcccaatggaatcatcctagagtatgaaatcaagtattttgaaaaggaccaagagaccagctacacgattatcaaatctaaagagacaactattactgcagagggcttgaaaccagcttcagtttatgtcttccaaattcgagcacgtacagcagcaggctatggtgtcttcagtcgaagatttgagtttgaaaccaccccagtgtcagttgcagcatccagcgatcaaagccagattcctgtaattgctgtgtctgtgacagtgggagtcattttgttggcagtggttatcggcgtcctcctcagtggaaggcggtgtggctacagcaaagcaaaacaagatccagaagaggaaaagatgcattttcataatgggcacattaaactgccaggagtaagaacttacattgatccacatacctatgaggatcccaatcaagctgtccacgaatttgctaaggagatagaagcatcatgtatcaccattgagagagttattggagcaggtgaatttggtgaagtttgtagtggacgtttgaaactaccaggaaaaagagaattacctgtggctatcaaaacccttaaagtaggctatactgaaaagcaacgcagagatttcctaggtgaagcaagtatcatgggacagtttgatcatcctaacatcatccatttagaaggtgtggtgaccaaaagtaaaccagtgatgatcgtgacagagtatatggagaatggctctttagatacatttttgaagaaaaacgatgggcagttcactgtgattcagcttgttggcatgctgagaggtatctctgcaggaatgaagtacctttctgacatgggctatgtgcatagagatcttgctgccagaaacatcttaatcaacagtaaccttgtgtgcaaagtgtctgactttggactttcccgggtactggaagatgatcccgaggcagcctacaccacaaggggaggaaaaattccaatcagatggactgccccagaagcaatagctttccgaaagtttacttctgccagtgatgtctggagttatggaatagtaatgtgggaagttgtgtcttatggagagagaccctactgggagatgaccaatcaagatgtgattaaagcggtagaggaaggctatcgtctgccaagccccatggattgtcctgctgctctctatcagttaatgctggattgctggcagaaagagcgaaatagcaggcccaagtttgatgaaatagtcaacatgttggacaagctgatacgtaacccaagtagtctgaagacgctggttaatgcatcctgcagagtatctaatttattggcagaacatagcccactaggatctggggcctacagatcagtaggtgaatggctagaggcaatcaagatgggccggtatacagagattttcatggaaaatggatacagttcaatggacgctgtggctcaggtgaccttggaggatttgagacggcttggagtgactcttgtcggtcaccagaagaagatcatgaacagccttcaagaaatgaaggtgcagctggtaaacggaatggtgccattgtaacttcatgtaaatgtcgcttcttcaagtgaatgattctgcactttgtaaacagcactgagatttattttaacaaaaaaagggggaaaagggaaaacagtgatttctaaaccttagaaaacatttgcctcagccacagaatttgtaatcatggttttactgaagtatccagttcttagtccttagtcttcatttttcatgaagcaaacatatcttgcattaaaagggacatgaagttagacatcatcttaagttacaacaacagaatccttcccactacttctacaaaattttgtacatgaaatatataattatatagcacttttatagactgaattaaggcaacccctttcaaaacttccagggatctacttgaaaggaaatgttttatagccatttgtgagctaacaaaagctacagtttactgaagtttacttcaagtcttaattgtctacaaaagtgtattgaagagcaatatgattagattatttcttaatagatatcttcttttgtaattttaaaatgctgttacacagcgttaagttatagaaactagtgtgtaaacatgttgcttgatcaagaaaaagtacaatacagggtgtatatttattttttgtgttataaagtttacttttagttgctcttctagagattattaggtaataaatgtgtatatactgtataatttgcaatatacccaggaactgatttaagatggaattgtgtgtgtgtttgcttgcacatgtgtgtgttaccattctgcttgcatttctaatagtgtttcaattttagcaacatataggagcaagtgttccagaatgtaatatgaataggagaaatagggaagcagtaaaacaaaatttaacacaagcttgtgtctcttttcctctcatgtgtccaaaagctaatctctttattcactaaaaggaaatgtgtataagactaaatcccctttggctttttaaaaacattttgtgatatcagtgacaatgcagttcttctagccattaatcttgtacccctgtaagaaatttcacctttctgagtcctgaaaagtatcttgtcaagcaaagttgacaccgaagggcacattttcagcaggatgtagaaggatttaactgtgcaggcttctgttaatgttgttaaatccaggcacatagcacgaagcatcacccttaagtgttaatccgttgtaaccattcccattttgactcagttctagaaattttgactctaaggcagcaatggaattatgacaaatatatatatatacacatacacacacacaaatatatatatatgcttatttcccttcagaattttatttcaataattgataagttttatttttaatggatgtttattcatttgttaatttcagtttgtattcagttacatggctttgagtttattttattgaaccaatccaaggtattatgtaattaggcttattaaggaatataacatatcttctatgtatgctctatataccacacatgatgaagacttatatttgtgatacaaattatgcagtgtattagaaattgtccaaaactgagctcctgagataaccaacatttttgtattattacactttataaaaattatggaatgtcatgtgattagtcaaaatcagagcatttaaataaaatacagcctactcatgattatcaatgttaatagtacagtagatcagagaagcctggattaatgaaatttatcagaaatatagccacgttatattaatggtattcttttttccaagcacttgttttatttgaatattagcacatataagaataaacttttgggaaataactacttcctattctgcccaccctttacttaagcagtaaagtacctcttttctaaagaaccaggaaacatcaaaataaccacaacaaaaatctaaacagttttcaaataatacattcagttctcataataataagggctatataccatgggtccacacaaactgtgctgcaaacatataatctattagtttagtaaaatttccagagatgtgaatttaatattttcttgataaaatcataaaaaagcatcaccattattaaagatgcatttgttcatttcaataaacagaaattaatgaaacaaattacttttgtacaaaataaatgatgattatgtggcactttattgaattttatagaaatattccaatctaagtgataaagtaacaactgagaaacttcagaatgaaagccttattgattcaaaaggaaaattaccatatgctttagggctgatgaacttgccacaattgcttagacataacaaagatattttctacattgttttccaactttatatgctgaaagataattaggaggtccgggtggagtgtatctaaatgactagaactttaagttgcaatatagattttctctttttaacaaaggaagaatataaattaatttggatcaaatttatttgccttctttgcaatcttggtgatcattttggaaagtaaattgaaaggaaagttaaatagccacatagttttcttttgcatctcaatttggttgagaatttctaaggaaggttaatatgactttagaatgaataaagagactgtcaaacaacaagtactctccctaaaaaagaggaaagaatgccttcctaaaatatttgtttcctattgtatatgtcaccaattggaaaatgccaatctcatctgcaagtgtgagaaatggaacaaggagaggagccaactctagtaaaatgtagtgaggccataatccaaggcaaagtttaacaaatcttgattgtgtaatttcttattctgttgattcattttgtcacccaccagactaccaaaaataaagcacagacatgacaattttagtatatacaacagatttggcaaataatacataatcttattgtaattgccagtagcaatatcttaaggggcatgagtctttcacagtattggactttgaaaaattggtacagggagtaattttcaacagactgatacttgaagtcactcaattactactttgacctatcataatttgtttctaatcttgtcatttgctcatatatactattaatataaccagttgctcttttcataatgtactatttctatgtaaagatgtaaagattttgattttcctatgttttaaaattgtaatgtgcatgatcttttatttcttgtgtttcaattaccaagtcagtattctaaggttgtaagattactgtaaaaattatattccaatattttatctaaacttaagtgtggccagcattattggtttcagagttgcctaaacaacacagaatatccttaattcagtttgtaaaagagttttgaccagtgtaaaaaagtgaagacacagtttcatgtttcaagtttaaaatggaaagttaatatcatttgagcacttatgtgttttcatgtcttctacttaatctgtatgtgaaagtaaaatatttttaacaccattatttatgccatgtaaagtgggttctcagaagcacaagcacagatatttaccttctgaagacatttttggctataaaagtgcattggatggcaaacactatttgagtcaggtgttagaaatttattagatgtattatattacatagtagaataaggtccctttctcattttgtttttcctaaaaataagaaaaaaaagaagtgtgatagtaaactgtctttgctaatgtcctgccagatgtttaacttcaaattaagcaaaaagtaggtacaatatgatgatgatcctgatgatgatgatgatgatgatgatgaagaataaatggaatcaaaatgctagctttatttgacattaataagtaaaataagtcatcattttttcaactctgtagcacagctgtttacattgaataattttctctattgtgctgttaattatatagtaatgtatcaaaatagaaataggaactttcttttcatttcttattcatttatgaagaaatcttttcacacataaatgattgaatgttcttgttcagaatgaccacataatcattgcttagaagaagataccaattcttttaaaagaaaaaaagtctgtttataataatcagaatcaaatgttgtttgtttcttctaaacgttaatggagaaaattgaaggtggtaaaatgtcatgtttattcaggctgggaactgtattcacagtagaagtttcagtggtcaacatatctatgactctttaggctgctgtagttttacagtcaattatttaaaagtgagtagttacatttataagagcctgagaatacttagactcagtcatttgttagtatttttaccaaaatctcttagtttcagacatgtcagaagcagctatatagcatatcttattctatgatatacatcaggctatctcaagttcctgtctcacagttaattcaaagaaggattaggatttctgtattttttctcatttgaatctttatgtgcatttggtttgtgtacatgctttttgtagtgtaagatatgaaattttatattttttcagaaaataaaaaccctttgaatacagtta

SEQ ID NO: 130074 - DNA, 8421 bp, Homo sapiens
  Payload ID: 5448
  Gene Symbol: EPHA5
  Gene Name: EPH receptor A5
  ENST ID: ENST00000622150
  CDS Start-End: 754-3870
ccagacacagcaggagcgcgccttggcggtgcagtttcaacctcgacttcgcagccgcgcacacaccgcctgctccccgagcagcgggaaccgcagcagctcctgggccgccgcagcgcagctccgcgctcctaccggccggcagccgtcagtccctcccctcttcagcactcagcccgcagctatttccttctgccagtctctttgaactctggatctttgcttttgctcgctgctctcctgtttttcattctccacattttctcaagtcctctttctttatccttagccaccctgcttttttcctccttttttaaaaaatcggagatttcgtcttaaaatgatttgccttccttaccttcgtccatttcaacactgaaggctgcaaagaaccttcacctttcccctagtggtatttaaaaattctcaatccgtaaaaagtctttttgaaaggcaaaggaacaggacccaggaccctctcgacacccttgatccgagtccagatctgcactagcaaccagaactaatatttcatttaaccccaccaaagggggaggcgagaggagccagaagcaaacttcagctgtctcagccggatccgtggttcctacatttggaggagccgcgtgccagaaggcgtaggaccccaaggggggacaaggaggactcccgagtctcccttcgccgctctgcgaggccgaagcggtggactgagccgctcgggacagcggcaccggaggaggctcggagaagatgcggggctcggggccccggggtgcgggacgccggcggcccccaagcggcggcggcgacacccccatcaccccagcgtccctggccggctgctactctgcacctcgacgggctcccctctggacgtgccttctcctgtgcgccgcactccggaccctcctggccagccccagcaacgaagtgaatttattggattcacgcactgtcatgggggacctgggatggattgcttttccaaaaaatgggtgggaagagattggtgaagtggatgaaaattatgcccctatccacacataccaagtatgcaaagtgatggaacagaatcagaataactggcttttgaccagttggatctccaatgaaggtgcttccagaatcttcatagaactcaaatttaccctgcgggactgcaacagccttcctggaggactggggacctgtaaggaaacctttaatatgtattactttgagtcagatgatcagaatgggagaaacatcaaggaaaaccaatacatcaaaattgataccattgctgccgatgaaagctttacagaacttgatcttggtgaccgtgttatgaaactgaatacagaggtcagagatgtaggacctctaagcaaaaagggattttatcttgcttttcaagatgttggtgcttgcattgctctggtttctgtgcgtgtatactataaaaaatgcccttctgtggtacgacacttggctgtcttccctgacaccatcactggagctgattcttcccaattgctcgaagtgtcaggctcctgtgtcaaccattctgtgaccgatgaacctcccaaaatgcactgcagcgccgaaggggagtggctggtgcccatcgggaaatgcatgtgcaaggcaggatatgaagagaaaaatggcacctgtcaagtgtgcagacctgggttcttcaaagcctcacctcacatccagagctgcggcaaatgtccacctcacagttatacccatgaggaagcttcaacctcttgtgtctgtgaaaaggattatttcaggagagagtctgatccacccacaatggcatgcacaagacccccctctgctcctcggaatgccatctcaaatgttaatgaaactagtgtctttctggaatggattccgcctgctgacactggtggaaggaaagacgtgtcatattatattgcatgcaagaagtgcaactcccatgcaggtgtgtgtgaggagtgtggcggtcatgtcaggtaccttccccggcaaagcggcctgaaaaacacctctgtcatgatggtggatctactcgctcacacaaactatacctttgagattgaggcagtgaatggagtgtccgacttgagcccaggagcccggcagtatgtgtctgtaaatgtaaccacaaatcaagcagctccatctccagtcaccaatgtgaaaaaagggaaaattgcaaaaaacagcatctctttgtcttggcaagaaccagatcgtcccaatggaatcatcctagagtatgaaatcaagtattttgaaaaggaccaagagaccagctacacgattatcaaatctaaagagacaactattactgcagagggcttgaaaccagcttcagtttatgtcttccaaattcgagcacgtacagcagcaggctatggtgtcttcagtcgaagatttgagtttgaaaccaccccagtgtcagttgcagcatccagcgatcaaagccagattcctgtaattgctgtgtctgtgacagtgggagtcattttgttggcagtggttatcggcgtcctcctcagtggaagttgctgcgaatgtggctgtgggagggcttcttccctgtgcgctgttgcccatccaagcctaatatggcggtgtggctacagcaaagcaaaacaagatccagaagaggaaaagatgcattttcataatgggcacattaaactgccaggagtaagaacttacattgatccacatacctatgaggatcccaatcaagctgtccacgaatttgctaaggagatagaagcatcatgtatcaccattgagagagttattggagcaggtgaatttggtgaagtttgtagtggacgtttgaaactaccaggaaaaagagaattacctgtggctatcaaaacccttaaagtaggctatactgaaaagcaacgcagagatttcctaggtgaagcaagtatcatgggacagtttgatcatcctaacatcatccatttagaaggtgtggtgaccaaaagtaaaccagtgatgatcgtgacagagtatatggagaatggctctttagatacatttttgaagaaaaacgatgggcagttcactgtgattcagcttgttggcatgctgagaggtatctctgcaggaatgaagtacctttctgacatgggctatgtgcatagagatcttgctgccagaaacatcttaatcaacagtaaccttgtgtgcaaagtgtctgactttggactttcccgggtactggaagatgatcccgaggcagcctacaccacaaggggaggaaaaattccaatcagatggactgccccagaagcaatagctttccgaaagtttacttctgccagtgatgtctggagttatggaatagtaatgtgggaagttgtgtcttatggagagagaccctactgggagatgaccaatcaagatgtgattaaagcggtagaggaaggctatcgtctgccaagccccatggattgtcctgctgctctctatcagttaatgctggattgctggcagaaagagcgaaatagcaggcccaagtttgatgaaatagtcaacatgttggacaagctgatacgtaacccaagtagtctgaagacgctggttaatgcatcctgcagagtatctaatttattggcagaacatagcccactaggatctggggcctacagatcagtaggtgaatggctagaggcaatcaagatgggccggtatacagagattttcatggaaaatggatacagttcaatggacgctgtggctcaggtgaccttggaggatttgagacggcttggagtgactcttgtcggtcaccagaagaagatcatgaacagccttcaagaaatgaaggtgcagctggtaaacggaatggtgccattgtaacttcatgtaaatgtcgcttcttcaagtgaatgattctgcactttgtaaacagcactgagatttattttaacaaaaaaagggggaaaagggaaaacagtgatttctaaaccttagaaaacatttgcctcagccacagaatttgtaatcatggttttactgaagtatccagttcttagtccttagtcttcatttttcatgaagcaaacatatcttgcattaaaagggacatgaagttagacatcatcttaagttacaacaacagaatccttcccactacttctacaaaattttgtacatgaaatatataattatatagcacttttatagactgaattaaggcaacccctttcaaaacttccagggatctacttgaaaggaaatgttttatagccatttgtgagctaacaaaagctacagtttactgaagtttacttcaagtcttaattgtctacaaaagtgtattgaagagcaatatgattagattatttcttaatagatatcttcttttgtaattttaaaatgctgttacacagcgttaagttatagaaactagtgtgtaaacatgttgcttgatcaagaaaaagtacaatacagggtgtatatttattttttgtgttataaagtttacttttagttgctcttctagagattattaggtaataaatgtgtatatactgtataatttgcaatatacccaggaactgatttaagatggaattgtgtgtgtgtttgcttgcacatgtgtgtgttaccattctgcttgcatttctaatagtgtttcaattttagcaacatataggagcaagtgttccagaatgtaatatgaataggagaaatagggaagcagtaaaacaaaatttaacacaagcttgtgtctcttttcctctcatgtgtccaaaagctaatctctttattcactaaaaggaaatgtgtataagactaaatcccctttggctttttaaaaacattttgtgatatcagtgacaatgcagttcttctagccattaatcttgtacccctgtaagaaatttcacctttctgagtcctgaaaagtatcttgtcaagcaaagttgacaccgaagggcacattttcagcaggatgtagaaggatttaactgtgcaggcttctgttaatgttgttaaatccaggcacatagcacgaagcatcacccttaagtgttaatccgttgtaaccattcccattttgactcagttctagaaattttgactctaaggcagcaatggaattatgacaaatatatatatatacacatacacacacacaaatatatatatatgcttatttcccttcagaattttatttcaataattgataagttttatttttaatggatgtttattcatttgttaatttcagtttgtattcagttacatggctttgagtttattttattgaaccaatccaaggtattatgtaattaggcttattaaggaatataacatatcttctatgtatgctctatataccacacatgatgaagacttatatttgtgatacaaattatgcagtgtattagaaattgtccaaaactgagctcctgagataaccaacatttttgtattattacactttataaaaattatggaatgtcatgtgattagtcaaaatcagagcatttaaataaaatacagcctactcatgattatcaatgttaatagtacagtagatcagagaagcctggattaatgaaatttatcagaaatatagccacgttatattaatggtattcttttttccaagcacttgttttatttgaatattagcacatataagaataaacttttgggaaataactacttcctattctgcccaccctttacttaagcagtaaagtacctcttttctaaagaaccaggaaacatcaaaataaccacaacaaaaatctaaacagttttcaaataatacattcagttctcataataataagggctatataccatgggtccacacaaactgtgctgcaaacatataatctattagtttagtaaaatttccagagatgtgaatttaatattttcttgataaaatcataaaaaagcatcaccattattaaagatgcatttgttcatttcaataaacagaaattaatgaaacaaattacttttgtacaaaataaatgatgattatgtggcactttattgaattttatagaaatattccaatctaagtgataaagtaacaactgagaaacttcagaatgaaagccttattgattcaaaaggaaaattaccatatgctttagggctgatgaacttgccacaattgcttagacataacaaagatattttctacattgttttccaactttatatgctgaaagataattaggaggtccgggtggagtgtatctaaatgactagaactttaagttgcaatatagattttctctttttaacaaaggaagaatataaattaatttggatcaaatttatttgccttctttgcaatcttggtgatcattttggaaagtaaattgaaaggaaagttaaatagccacatagttttcttttgcatctcaatttggttgagaatttctaaggaaggttaatatgactttagaatgaataaagagactgtcaaacaacaagtactctccctaaaaaagaggaaagaatgccttcctaaaatatttgtttcctattgtatatgtcaccaattggaaaatgccaatctcatctgcaagtgtgagaaatggaacaaggagaggagccaactctagtaaaatgtagtgaggccataatccaaggcaaagtttaacaaatcttgattgtgtaatttcttattctgttgattcattttgtcacccaccagactaccaaaaataaagcacagacatgacaattttagtatatacaacagatttggcaaataatacataatcttattgtaattgccagtagcaatatcttaaggggcatgagtctttcacagtattggactttgaaaaattggtacagggagtaattttcaacagactgatacttgaagtcactcaattactactttgacctatcataatttgtttctaatcttgtcatttgctcatatatactattaatataaccagttgctcttttcataatgtactatttctatgtaaagatgtaaagattttgattttcctatgttttaaaattgtaatgtgcatgatcttttatttcttgtgtttcaattaccaagtcagtattctaaggttgtaagattactgtaaaaattatattccaatattttatctaaacttaagtgtggccagcattattggtttcagagttgcctaaacaacacagaatatccttaattcagtttgtaaaagagttttgaccagtgtaaaaaagtgaagacacagtttcatgtttcaagtttaaaatggaaagttaatatcatttgagcacttatgtgttttcatgtcttctacttaatctgtatgtgaaagtaaaatatttttaacaccattatttatgccatgtaaagtgggttctcagaagcacaagcacagatatttaccttctgaagacatttttggctataaaagtgcattggatggcaaacactatttgagtcaggtgttagaaatttattagatgtattatattacatagtagaataaggtccctttctcattttgtttttcctaaaaataagaaaaaaaagaagtgtgatagtaaactgtctttgctaatgtcctgccagatgtttaacttcaaattaagcaaaaagtaggtacaatatgatgatgatcctgatgatgatgatgatgatgatgatgaagaataaatggaatcaaaatgctagctttatttgacattaataagtaaaataagtcatcattttttcaactctgtagcacagctgtttacattgaataattttctctattgtgctgttaattatatagtaatgtatcaaaatagaaataggaactttcttttcatttcttattcatttatgaagaaatcttttcacacataaatgattgaatgttcttgttcagaatgaccacataatcattgcttagaagaagataccaattcttttaaaagaaaaaaagtctgtttataataatcagaatcaaatgttgtttgtttcttctaaacgttaatggagaaaattgaaggtggtaaaatgtcatgtttattcaggctgggaactgtattcacagtagaagtttcagtggtcaacatatctatgactctttaggctgctgtagttttacagtcaattatttaaaagtgagtagttacatttataagagcctgagaatacttagactcagtcatttgttagtatttttaccaaaatctcttagtttcagacatgtcagaagcagctatatagcatatcttattctatgatatacatcaggctatctcaagttcctgtctcacagttaattcaaagaaggattaggatttctgtattttttctcatttgaatctttatgtgcatttggtttgtgtacatgctttttgtagtgtaagatatgaaattttatattttttcagaaaataaaaaccctttgaatacagtta

SEQ ID NO: 130075 - DNA, 3971 bp, Homo sapiens
  Payload ID: 5449
  Gene Symbol: EPHA6
  Gene Name: EPH receptor A6
  ENST ID: ENST00000389672
  CDS Start-End: 39-3431
aagtgaatagtcctcgcgcaagcgggacactgtggtggatgcaattcccctcgcctccagccgcgaggagctccccggcgccgcaggcagcgtcctcctccgaagcagctgcacctgcaactgggcagcctggaccctcgtgccctgttcccgggacctcgcgcagggggcgccccgggacaccccctgcgggccgggtggaggaggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttgcaatttggtttcttcttgcctctgctgacagcgtggccaggcgactgcagtcacgtctccaacaaccaagttgtgttgcttgatacaacaactgtactgggagagctaggatggaaaacatatccattaaatgggtgggatgccatcactgaaatggatgaacataataggcccattcacacataccaggtatgtaatgtaatggaaccaaaccaaaacaactggcttcgtacaaactggatctcccgtgatgcagctcagaaaatttatgtggaaatgaaattcacactaagggattgtaacagcatcccatgggtcttggggacttgcaaagaaacatttaatctgttttatatggaatcagatgagtcccacggaattaaattcaagccaaaccagtatacaaagatcgacacaattgctgctgatgagagttttacccagatggatttgggtgatcgcatcctcaaactcaacactgaaattcgtgaggtggggcctatagaaaggaaaggattttatctggcttttcaagacattggggcgtgcattgccctggtttcagtccgtgttttctacaagaaatgccccttcactgttcgtaacttggccatgtttcctgataccattccaagggttgattcctcctctttggttgaagtacggggttcttgtgtgaagagtgctgaagagcgtgacactcctaaactgtattgtggagctgatggagattggctggttcctcttggaaggtgcatctgcagtacaggatatgaagaaattgagggttcttgccatgcttgcagaccaggattctataaagcttttgctgggaacacaaaatgttctaaatgtcctccacacagtttaacatacatggaagcaacttctgtctgtcagtgtgaaaagggttatttccgagctgaaaaagacccaccttctatggcatgtaccaggccaccttcagctcctaggaatgtggtttttaacatcaatgaaacagcccttattttggaatggagcccaccaagtgacacaggagggagaaaagatctcacatacagtgtaatctgtaagaaatgtggcttagacaccagccagtgtgaggactgtggtggaggactccgcttcatcccaagacatacaggcctgatcaacaattccgtgatagtacttgactttgtgtctcacgtgaattacacctttgaaatagaagcaatgaatggagtttctgagttgagtttttctcccaagccattcacagctattacagtgaccacggatcaagatgcaccttccctgataggtgtggtaaggaaggactgggcatcccaaaatagcattgccctatcatggcaagcacctgctttttccaatggagccattctggactacgagatcaagtactatgagaaagaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaacttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactggtggaaaaatccccataaggtggacagccccagaagccatcgcctacagaaaattctcctcagcaagcgatgcatggagctatggcattgtcatgtgggaggtcatgtcctatggagagagaccttattgggaaatgtctaaccaagatgtcattctgtccattgaagaagggtacagacttccagctcccatgggctgtccagcatctctacaccagctgatgctccactgctggcagaaggagagaaatcacagaccaaaatttactgacattgtcagcttccttgacaaactgatccgaaatcccagtgcccttcacaccctggtggaggacatccttgtaatgccagagtcccctggtgaagttccggaatatcctttgtttgtcacagttggtgactggctagattctataaagatggggcaatacaagaataacttcgtggcagcagggtttacaacatttgacctgatttcaagaatgagcattgatgacattagaagaattggagtcatacttattggacaccagagacgaatagtcagcagcatacagactttacgtttacacatgatgcacatacaggagaagggatttcatgtatgaaagtaccacaagcacctgtgttttgtgcctcagcatttctaaaatgaacgatatcctctctactactctctcttctgattctccaaacatcacttcacaaactgcagtcttctgttcagactataggcacacaccttatgtttatgcttccaaccaggattttaaaatcatgctacataaatccgttctgaataacctgcaactaaaaccctggcccactgcagattattgctacgcaatggtaaataactcagcatggatgtgtaattttgtataagccgtatatgggaagtgttcacggacttaacctaaaaaaatttatccaggtggggcttccttagtgatgtatgtagagtgtgatggtagatgagaaagaactagttgacctttctttcatgttttgtgatcaagtagcttccaaactgacagaaatgtttcatttttagataattatattcagctctattggttgtattattactttattttttaatactttaactgttggtgcctgatattgttagaattatttgcagaaat

SEQ ID NO: 130076 - DNA, 1690 bp, Homo sapiens
  Payload ID: 5449
  Gene Symbol: EPHA6
  Gene Name: EPH receptor A6
  ENST ID: ENST00000477384
  CDS Start-End: 277-1398
agagtggaacttcccagcctcagaaaggcagaaaccaggaaagctaagacaaacaaaactacaatggaagaagaaaacgtcctcaactagacatctgccaaaaatgaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaacttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactggtggaaaaatccccataaggtggacagccccagaagccatcgcctacagaaaattctcctcagcaagcgatgcatggagctatggcattgtcatgtgggaggtcatgtcctatggagagagaccttattgggaaatgtctaaccaagatgtcattctgtccattgaagaagggtacagacttccagctcccatgggctgtccagcatctctacaccagctgatgctccactgctggcagaaggagagaaatcacagaccaaaatttactgacattgtcagcttccttgacaaactgatccgaaatcccagtgcccttcacaccctggtggaggacatccttgtgtcaaatcatgaatcattttgatgttaattaaaatgaaacagcccacaatcaaaataacgttgcaatatgtagtacaggaaaaaagaatgcagcttaacagcctccaaataggaaatgcaatagaattgagtagtgttaaaaaggacagaagtcactgtatggataaccagacccaatattgactacagtgtaatcaatcacaagaatgccagagtcccctggtgaagttccggaatatcctttgtttgtcacagttggtgactggctagattctataaagatggggcaatacaagaataacttcgtggcagca

SEQ ID NO: 130077 - DNA, 2058 bp, Homo sapiens
  Payload ID: 5449
  Gene Symbol: EPHA6
  Gene Name: EPH receptor A6
  ENST ID: ENST00000470610
  CDS Start-End: 44-1687
ggcccaagtgaatagtcctcgcgcaagcgggacactgtggtggatgcaattcccctcgcctccagccgcgaggagctccccggcgccgcaggcagcgtcctcctccgaagcagctgcacctgcaactgggcagcctggaccctcgtgccctgttcccgggacctcgcgcagggggcgccccgggacaccccctgcgggccgggtggaggaggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttgcaatttggtttcttcttgcctctgctgacagcgtggccaggcgactgcagtcacgtctccaacaaccaagttgtgttgcttgatacaacaactgtactgggagagctaggatggaaaacatatccattaaatgggtgggatgccatcactgaaatggatgaacataataggcccattcacacataccaggtatgtaatgtaatggaaccaaaccaaaacaactggcttcgtacaaactggatctcccgtgatgcagctcagaaaatttatgtggaaatgaaattcacactaagggattgtaacagcatcccatgggtcttggggacttgcaaagaaacatttaatctgttttatatggaatcagatgagtcccacggaattaaattcaagccaaaccagtatacaaagatcgacacaattgctgctgatgagagttttacccagatggatttgggtgatcgcatcctcaaactcaacactgaaattcgtgaggtggggcctatagaaaggaaaggattttatctggcttttcaagacattggggcgtgcattgccctggtttcagtccgtgttttctacaagaaatgccccttcactgttcgtaacttggccatgtttcctgataccattccaagggttgattcctcctctttggttgaagtacggggttcttgtgtgaagagtgctgaagagcgtgacactcctaaactgtattgtggagctgatggagattggctggttcctcttggaaggtgcatctgcagtacaggatatgaagaaattgagggttcttgccatgcttgcagaccaggattctataaagcttttgctgggaacacaaaatgttctaaatgtcctccacacagtttaacatacatggaagcaacttctgtctgtcagtgtgaaaagggttatttccgagctgaaaaagacccaccttctatggcatgtaccaggccaccttcagctcctaggaatgtggtttttaacatcaatgaaacagcccttattttggaatggagcccaccaagtgacacaggagggagaaaagatctcacatacagtgtaatctgtaagaaatgtggcttagacaccagccagtgtgaggactgtggtggaggactccgcttcatcccaagacatacaggcctgatcaacaattccgtgatagtacttgactttgtgtctcacgtgaattacacctttgaaatagaagcaatgaatggagtttctgagttgagtttttctcccaagccattcacagctattacagtgaccacggatcaagatggtaagttccactgctgttctctcaaaacagacccataatttcttttgatgcataaatatccctcatgggcatgtatttattgcaggtgctatgcagtcatatacgttatacactgcagaggtaatgcactggttgttgttcttgttctttcctaaaactcagaaagatatttttatattacttctcagcagtatgaataataagatgaaatgcttccctccactgtttatgtactcatgtattttgtataatcatataacaatatatcttaatgagtaagtccatattacttaccaatagaagtcagaaatcaataaaatgttattaaatgaattgaatttcaattgccccacttatgctgccatcctttttgcatgtcaaataaagcaaatagtaagaatttttaaaa

SEQ ID NO: 130078 - DNA, 1413 bp, Homo sapiens
  Payload ID: 5449
  Gene Symbol: EPHA6
  Gene Name: EPH receptor A6
  ENST ID: ENST00000503760
  CDS Start-End: 263-889
agagtggaacttcccagcctcagaaaggcagaaaccaggaaagctaagacaaacaaaactacaatggaagaagaaaacgtcctcaactagacatctgccaaaaatgaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaagactctccatttcaagtgacaaaactgtactggcttaatgaaaagtgggactttattgcctcagcttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaaagccactggaaatgatgacatatatcctcagggcaaaaggggaagcaggctttctaaagaagtaaatcaaggcacactagccacatttccagtgctcaatagccacatatggctggtggctactgtattggacaacacaaacatagaatattttcatcattgctgaaaattggagtgaacagctttgatcttggtgatatggatgaagacccagagaggggttatgactcctctgtgctgtcgtatagctggctcagaagagaccaactttcctgagctgtgaaaaatgacagttccttaaggaagagatgccacaatagatgaaagacctttttacccatggatccttcccggccattggggtggaggcgttttgccccagcttcctgagggcagggtttttaaatagcatccaggccccgcatccagtgccagggggaggatctttgccccccaggattcctgctgtgcccttcctactatacaccccatgagagcagagatcttgtattgattgacgatatgtctccagaactcagaagagtacttgctacctagcagaccagtaatgattgtggtggaatatatg

SEQ ID NO: 130079 - DNA, 681 bp, Homo sapiens
  Payload ID: 5449
  Gene Symbol: EPHA6
  Gene Name: EPH receptor A6
  ENST ID: ENST00000506349
  CDS Start-End: 1-168
ttcgtggcagcagggtttacaacatttgacctgatttcaagaatgagcattgatgacattagaagaattggagtcatacttattggacaccagagacgaatagtcagcagcatacagactttacgtttacacatgatgcacatacaggagaagggatttcatgtatgaaagtaccacaagcacctgtgttttgtgcctcagcatttctaaaatgaacgatatcctctctactactctctcttctgattctccaaacatcacttcacaaactgcagtcttctgttcagactataggcacacaccttatgtttatgcttccaaccaggattttaaaatcatgctacataaatccgttctgaataacctgcaactaaaaccctggcccactgcagattattgctacgcaatgcaacagctttaaaacctatctcagcccatgaatggaaaacaaatccaaatccgatccttgaaaagcaaaggctctaaagaagctcttcagaagagacggtaaagaatgaattcttttacttatcacccaaccacatttcttaaaaatgtgttttggtgtcttttcctaccaaatttctgctctacaaggcagtcagttaaatctctcatttcataattttcactgtgctagttctttcttttctcctcttttaataaattttctaaaacttt

SEQ ID NO: 130080 - DNA, 1682 bp, Homo sapiens
  Payload ID: 5449
  Gene Symbol: EPHA6
  Gene Name: EPH receptor A6
  Uniprot ID: Q9UF33
  ENST ID: ENST00000514100
  CDS Start-End: 243-1439
cagaaaggcagaaaccaggaaagctaagacaaacaaaactacaatggaagaagaaaacgtcctcaactagacatctgccaaaaatgaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaagactctccatttcaagtgacaaaactgtactggcttaatgaaaagtgggactttattgcctcagcttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactagacccacaaatcacaacaaagagcaatcagaactggttaaagaagatggtctggaaagcttgtgtgagcagtgcgagtccagctctggttatggtactggactggtcctcatgtggaagagaaacagaagggccatgggagccagtggccagaccagaaagcaatgtgacaagagagataaccctccaacagacctcttccaaactctaacacttaacctctgctattctgcataaattctgagaaaagccaaattttctgtcggtctaagaagacatagcctacacccaactggagataattataaaaaataatgaagcagcatgaggggaaggtatttaatgtgtattttaaagttgggagagattctccttcacctaatttaggtgtttgtgaattggcttgactttttgaagttaatttttaagccttgaacatgtccaactttaagaactttaagaataaatattttaacacaa

SEQ ID NO: 130081 - DNA, 1582 bp, Homo sapiens
  Payload ID: 5449
  Gene Symbol: EPHA6
  Gene Name: EPH receptor A6
  Uniprot ID: Q9UF33
  ENST ID: ENST00000502694
  CDS Start-End: 331-1335
acaaacaaaactacaatggaagaagaaaacgtcctcaactagacatctgccaaaaatatcatccagaatgccctggcaagttcacttccatttagtgaagtgagataatttggcaattcacgcaagagactgagaaccaagcctcaagccctgcctctgattctgcaggtatggaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaagactctccatttcaagtgacaaaactgtactggcttaatgaaaagtgggactttattgcctcagcttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactgacctcttccaaactctaacacttaacctctgctattctgcataaattctgagaaaagccaaattttctgtcggtctaagaagacatagcctacacccaactggagataattataaaaaataatgaagcagcatgaggggaaggtatttaatgtgtattttaaagttgggagagattctccttcacctaatttaggtgtttgtgaattggcttgactttttgaagttaatttttaagccttgaacatgtccaactttaagaactttaagaataaatattttaacacaagtga

SEQ ID NO: 130082 - DNA, 1189 bp, Homo sapiens
  Payload ID: 5449
  Gene Symbol: EPHA6
  Gene Name: EPH receptor A6
  ENST ID: ENST00000508345
  CDS Start-End: 229-954
acaaacaaaactacaatggaagaagaaaacgtcctcaactagacatctgccaaaaatgaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaacttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggctgtatcctaaagcagaatataatggcaaacagtgtagcagatattcaatctaaattgctgctaaaaatggatcaaatgactaccacaagcaaataagaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccaga

SEQ ID NO: 130083 - DNA, 1078 bp, Homo sapiens
  Payload ID: 5449
  Gene Symbol: EPHA6
  Gene Name: EPH receptor A6
  ENST ID: ENST00000506569
  CDS Start-End: 1-973
ggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttgcaatttggtttcttcttgcctctgctgacagcgtggccaggcgactgcagtcacgtctccaacaaccaagttgtgttgcttgatacaacaactgtactgggagagctaggatggaaaacatatccattaaatgggtgggatgccatcactgaaatggatgaacataataggcccattcacacataccaggtatgtaatgtaatggaaccaaaccaaaacaactggcttcgtacaaactggatctcccgtgatgcagctcagaaaatttatgtggaaatgaaattcacactaagggattgtaacagcatcccatgggtcttggggacttgcaaagaaacatttaatctgttttatatggaatcagatgagtcccacggaattaaattcaagccaaaccagtatacaaagatcgacacaattgctgctgatgagagttttacccagatggatttgggtgatcgcatcctcaaactcaacactgaaattcgtgaggtggggcctatagaaaggaaaggattttatctggcttttcaagacattggggcgtgcattgccctggtttcagtccgtgttttctacaagaaatgccccttcactgttcgtaacttggccatgtttcctgataccattccaagggttgattcctcctctttggttgaagtacggggttcttgtgtgaagagtgctgaagagcgtgacactcctaaactgtattgtggagctgatggagattggctggttcctcttggaaggtgcatctgcagtacaggatatgaagaaattgagggttcttgccatggagcctccaaaggccgctgcttctagttggccatcttggccccaccccgaaacagtaacctttgaagaataaaagaaaaagcaaaagagtagcattactaaaatattaaacggttacatttacagccaaaa

SEQ ID NO: 130084 - DNA, 1885 bp, Homo sapiens
  Payload ID: 5450
  Gene Symbol: EPHA7
  Gene Name: EPH receptor A7
  Uniprot ID: Q15375
  ENST ID: ENST00000369297
  CDS Start-End: 207-1046
gagacttgcaggcagcaaacacggtgcgagcgaacaggagtgggggggaaattaaaaaaagctaaacgtggagcagccgatcggggaccgagaaggggaatcgatgcaaggagcacaataaaacaaaagctacttcggaacaaacagcatttaaaaatccacgactcaagataactgaaacctaaaataaaacctgctcatgcaccatggtttttcaaactcggtacccttcatggattattttatgctacatctggctgctccgctttgcacacacaggggaggcgcaggctgcgaaggaagtactactgctggattctaaagcacaacaaacagagttggagtggatttcctctccacccaatgggtgggaagaaattagtggtttggatgagaactataccccgatacgaacataccaggtgtgccaagtcatggagcccaaccaaaacaactggctgcggactaactggatttccaaaggcaatgcacaaaggatttttgtagaattgaaattcaccctgagggattgtaacagtcttcctggagtactgggaacttgcaaggaaacatttaatttgtactattatgaaacagactatgacactggcaggaatataagagaaaacctctatgtaaaaatagacaccattgctgcagatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtgtactacaagaagtgctggtccattattgagaacttagctatctttccagatacagtgactggttcagaattttcctctttagtcgaggttcgagggacatgtgtcagcagtgcagaggaagaagcggaaaacgcccccaggatgcactgcagtgcagaaggagaatggttagtgcccattggaaaatgtatctgcaaagcaggctaccagcaaaaaggagacacttgtgaacgtaagtaatgtgtcctattaaaactccactttgcctttttaaatttcagtatcagacattttaaactttaatagttatttgaatacgtgaatctgctctgtaccagaagcgcaattcagtagatcttaaacaaagtcaccgttgaacttagtgattgccctacagtagcatctgcactaagtgtatgtaatcaatataggtgataatgaaatttgttactaaaatttaatgtgtcctatgcttaacatggaagtcaatagttgcacgttgggctatggagtttagagaggagtctgggtagttggacatatagcctggcaagactgaggtgacatttaacaggatttaatgagatgccattcctcctgtttttaaacccatattgtctgggcccttgagtagcagtaaataggaggttaagagggctgtgaataagagctctagtgacaggcagggcataaacgaatatatttacaaacttttagaattatcttatataaatactataactttaatacaaaattttcaaatttcacttacaaaatctctgtggttacttctgagaaaggtgtgtgttttttttttttttttttggactaagtaccaaaatgaccacatttttgtgaaagtgggccaaagtaaagttttaattattatagtacaccaattgcatgttttgaaacaatcatgtatgaattagtaaacttttttctttgttttataaaaccgttttttttctttcctagcattatgtggctaaatatttaaaactatgtcatatggaccttcaagattgatagatattctgtttctaggtttcatgaaaataaattataaagttatgtta

SEQ ID NO: 130085 - DNA, 6588 bp, Homo sapiens
  Payload ID: 5450
  Gene Symbol: EPHA7
  Gene Name: EPH receptor A7
  Uniprot ID: Q15375
  ENST ID: ENST00000369303
  CDS Start-End: 186-3182
cggtgcgagcgaacaggagtgggggggaaattaaaaaaagctaaacgtggagcagccgatcggggaccgagaaggggaatcgatgcaaggagcacaataaaacaaaagctacttcggaacaaacagcatttaaaaatccacgactcaagataactgaaacctaaaataaaacctgctcatgcaccatggtttttcaaactcggtacccttcatggattattttatgctacatctggctgctccgctttgcacacacaggggaggcgcaggctgcgaaggaagtactactgctggattctaaagcacaacaaacagagttggagtggatttcctctccacccaatgggtgggaagaaattagtggtttggatgagaactataccccgatacgaacataccaggtgtgccaagtcatggagcccaaccaaaacaactggctgcggactaactggatttccaaaggcaatgcacaaaggatttttgtagaattgaaattcaccctgagggattgtaacagtcttcctggagtactgggaacttgcaaggaaacatttaatttgtactattatgaaacagactatgacactggcaggaatataagagaaaacctctatgtaaaaatagacaccattgctgcagatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtgtactacaagaagtgctggtccattattgagaacttagctatctttccagatacagtgactggttcagaattttcctctttagtcgaggttcgagggacatgtgtcagcagtgcagaggaagaagcggaaaacgcccccaggatgcactgcagtgcagaaggagaatggttagtgcccattggaaaatgtatctgcaaagcaggctaccagcaaaaaggagacacttgtgaaccctgtggccgtgggttctacaagtcttcctctcaagatcttcagtgctctcgttgtccaactcacagtttttctgataaagaaggctcctccagatgtgaatgtgaagatgggtattacagggctccatctgacccaccatacgttgcgtgcacaaggcctccatctgcaccacagaacctcattttcaacatcaaccaaaccacagtaagtttggaatggagtcctcctgcagacaatgggggaagaaacgatgtgacctacagaatattgtgtaagcggtgcagttgggagcagggcgaatgtgttccctgtgggagtaacattggatacatgccccagcagactggattagaggataactatgtcactgtcatggacctgctagcccacgctaattatacttttgaagttgaagctgtaaatggagtttctgacttaagccgatcccagaggctctttgctgctgtcagtatcaccactggtcaagcagctccctcgcaagtgagtggagtaatgaaggagagagtactgcagcggagtgtcgagctttcctggcaggaaccagagcatcccaatggagtcatcacagaatatgaaatcaagtattacgagaaagatcaaagggaacggacctactcaacagtaaaaaccaagtctacttcagcctccattaataatctgaaaccaggaacagtgtatgttttccagattcgggcttttactgctgctggttatggaaattacagtcccagacttgatgttgctacactagaggaagctacaggtaaaatgtttgaagctacagctgtctccagtgaacagaatcctgttattatcattgctgtggttgctgtagctgggaccatcattttggtgttcatggtctttggcttcatcattgggagaaggcactgtggttatagcaaagctgaccaagaaggcgatgaagagctttactttcattttaaatttccaggcaccaaaacctacattgaccctgaaacctatgaggacccaaatagagctgtccatcaattcgccaaggagctagatgcctcctgtattaaaattgagcgtgtgattggtgcaggagaattcggtgaagtctgcagtggccgtttgaaacttccagggaaaagagatgttgcagtagccataaaaaccctgaaagttggttacacagaaaaacaaaggagagactttttgtgtgaagcaagcatcatggggcagtttgaccacccgaatgttgtccatttggaaggggttgttacaagagggaaaccagtcatgatagtaatagagttcatggaaaatggagccctagatgcatttctcaggaaacatgatgggcaatttacagtcattcagttagtaggaatgctgagaggaattgctgctggaatgagatatttggctgatatgggatatgttcacagggaccttgcagctcgcaatattcttgtcaacagcaatctcgtttgtaaagtgtcagattttggcctgtcccgagttatagaggatgatccagaagctgtctatacaactactggtggaaaaattccagtaaggtggacagcacccgaagccatccagtaccggaaattcacatcagccagtgatgtatggagctatggaatagtcatgtgggaagttatgtcttatggagaaagaccttattgggacatgtcaaatcaagatgttataaaagcaatagaagaaggttatcgtttaccagcacccatggactgcccagctggccttcaccagctaatgttggattgttggcaaaaggagcgtgctgaaaggccaaaatttgaacagatagttggaattctagacaaaatgattcgaaacccaaatagtctgaaaactcccctgggaacttgtagtaggccaataagccctcttctggatcaaaacactcctgatttcactaccttttgttcagttggagaatggctacaagctattaagatggaaagatataaagataatttcacggcagctggctacaattcccttgaatcagtagccaggatgactattgaggatgtgatgagtttagggatcacactggttggtcatcaaaagaaaatcatgagcagcattcagactatgagagcacaaatgctacatttacatggaactggcattcaagtgtgatatgcatttctcccttttaagggagattacagactgcaagagaacagtactggccttcagtatatgcatagaatgctgctagaagacaagtgatgtcctgggtccttccaacagtgaagagaagatttaagaagcacctatagacttgaactcctaagtgccaccagaatatataaaaagggaatttaggatccaccatcggtggccaggaaaatagcagtgacaataaacaaagtactacctgaaaaacatccaaacaccttgagctctctaacctcctttttgtcttatagactttttaaaatgtacataaagaatttaagaaagaatatatttgtcaaataaaatcatgatcttattgttaaaattaatgaaatattttccttaaatatgtgatttcagactattcctttttaaaatcatttgtgtttattcttcataaggactttgttttagaaagctgtttatagctttggacctttttagtgttaaatctgtaacattactacactgggtacctttgaaagaatctcaaatttcaaaagaaatagcatgattgaagatacatctctgttagaacattggtatcctttttgtgccattttattctgtttaatcagtgctgttttgatattgtttgctaattggcaggtagtcaagaaaatgcaagttgccaagagctctgatattttttaaaaagaatttttttgtaaagatcagacaacacactatcttttcaatgaaaaaagcaataatgatccatacatactataaggcacttttaacagattgtttatagagtgattttactagaaagaatttaataaactcgaagtttaggtttatgagtatataaacaaatgaggcacttcatctgaagaatgttggtgaaggcaagtctctgaaagcagaactatccagtgttatctaaaaattaatctgagcacatcaagattttttcattctcgtgacattaggaaatttaggataaatagttgacatatattttatatcctcttctgttgaatgcagtccaaacatgaaaggaaataattgttttatattataactctgaagcatgataaaggggcagttcacaattttcaccatttaaacacaaatttgctgcacagaatatcaccattgcagttcaaaacaaaacaaaacaaaaagtcttttgtttgtgaacactgatgcaagaaacttgttaaatgaaaggactctttaccctagaaggaagaggtgaaggatctggcttgtttttaaagctttatttattaaaccatattatttgattactgtgttagaatttcataagcaataattaaatgtgtctttatagatattgcaggaatgtatacatattgtgattaatgctttcaaaacttatgaaaatcatgaactaccccagaattgaactgttgtacttccaaagagaattgggctgtttataatgattttaatagagaaagatcccagggatcggtcataattggtcttgtttgataatgtgggcatccacaaacaaacaaacaaataacagaaacaaaatctgtaaatgttcctttgtaaaacttgtaaattttatttatactgtcttgttttgtacacacatttctctgtagtgggctctgaatacattgaaaatgcactatatttttctattttacttgcagagcatcacaaaagaacaggtattttcagtgctacataatgtgttttcccacatttaggaccaaagacggctatagaaaaactcaaatggattgcttcccaaacccctccccaccctttttttttggttttaaatcactgtacagtgttatttgatattttaatttattttttgattgactagaaaaatcattttaatttcactaaaatgttttttgtccctaaggaaaagtaatctgtaaaaataattttaattagcataatacagtcacctagacacttccatttgtaatctttgtaatagactgtaaatatatttttggaactataacacaatgtgcttgagggttatttttcagtgtctgcagtgtgtacaagtgtttatactaagtccagcactttacaattctaatcagtagcattggcctttgtgagaatgagtgaaagagtttgagtgagtgttcttaattccttttggattctagactcactaataatgaagttcttttcttgttcatagcttaaggtgcttattttttctattaaaattaaattaacaaaagccattctagaaatagaagacatagtatggtacatgcaaacggtgtctttcctgcttttttctagcactagatttatagttgagtagtctttcttgagtagaagggcagaataaaagtttttttgagtttttttcaaaaataaatttttccttcagcaatatacctcatctgccttaaattttttacagctctttacagggaaaggggagaagggatgggaaagacacacagcacaataggaagtgtatgattacatcactatctcgtttgtaagtttcttttcctaatcaacattatgatttcgaaatacatgtatgtgaaacaaatattaagagaaaaagaattaacattgtaatgctgattgtaatactctcttccagaaagagatgagatggtataacgataagaatgtacaacttgcaccttgaaatctttttttttaaataaattagtgctcaggggaggaaaagtagagaaagtgaacgtcaaaaatagaattccaaaattataaaaatgcaaaaggaaatggcctccttgctttaatagagccaccttttttagaacactgtcctcacacttgacctgtgttttgcattcagtactgaaataaaagtaacttgttctacatttgaatctaacattttctcagcaattgatctggtccttgtttactagaactggtggtttatgcttgtcagagcactattagttgaatcatattgtatacttatgtaatctacattagctagtactgtttaggactatattttaattgctcttcttatccgtgtttttaagacaattaaaatggtgtgattcacctctcttttttatttaggtaatgctgatattctcccttttgtttcttgagtagcctagaactatgctactcactgatgtgcatgttcaaataaattactgatgtgtatttttttgctatatgtggagaaatcatggggaactcggggcgagatgtgcttttcgttggttgaatttgtccctccttgcctaagaaatactacaggggtcatccttttataaggacaaactgcttttgaacagtgtcttcaatgtatcaagcacaaataactctttcttcaacatgaatcataagtctctttttaccagcttaaaataataaacaagtctattagacaatgtaaagaaaa

SEQ ID NO: 130086 - DNA, 4943 bp, Homo sapiens
  Payload ID: 5451
  Gene Symbol: EPHA8
  Gene Name: EPH receptor A8
  Uniprot ID: P29322
  ENST ID: ENST00000166244
  CDS Start-End: 73-3090
tcccgacgcgcgggccgcagcggccaagcccgagggtgcgtggcgcccccgcccgcccggcccggcccggccatggcccccgcccggggccgcctgccccctgcgctctgggtcgtcacggccgcggcggcggcggccacctgcgtgtccgcggcgcgcggcgaagtgaatttgctggacacgtcgaccatccacggggactggggctggctcacgtatccggctcatgggtgggactccatcaacgaggtggacgagtccttccagcccatccacacgtaccaggtttgcaacgtcatgagccccaaccagaacaactggctgcgcacgagctgggtcccccgagacggcgcccggcgcgtctatgctgagatcaagtttaccctgcgcgactgcaacagcatgcctggtgtgctgggcacctgcaaggagaccttcaacctctactacctggagtcggaccgcgacctgggggccagcacacaagaaagccagttcctcaaaatcgacaccattgcggccgacgagagcttcacaggtgccgaccttggtgtgcggcgtctcaagctcaacacggaggtgcgcagtgtgggtcccctcagcaagcgcggcttctacctggccttccaggacataggtgcctgcctggccatcctctctctccgcatctactataagaagtgccctgccatggtgcgcaatctggctgccttctcggaggcagtgacgggggccgactcgtcctcactggtggaggtgaggggccagtgcgtgcggcactcagaggagcgggacacacccaagatgtactgcagcgcggagggcgagtggctcgtgcccatcggcaaatgcgtgtgcagtgccggctacgaggagcggcgggatgcctgtgtggcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccggccaccctcggcaccagtgaacctgatctccagtgtgaatgggacatcagtgactctggagtgggcccctcccctggacccaggtggccgcagtgacatcacctacaatgccgtgtgccgccgctgcccctgggcactgagccgctgcgaggcatgtgggagcggcacccgctttgtgccccagcagacaagcctggtgcaggccagcctgctggtggccaacctgctggcccacatgaactactccttctggatcgaggccgtcaatggcgtgtccgacctgagccccgagccccgccgggccgctgtggtcaacatcaccacgaaccaggcagccccgtcccaggtggtggtgatccgtcaagagcgggcggggcagaccagcgtctcgctgctgtggcaggagcccgagcagccgaacggcatcatcctggagtatgagatcaagtactacgagaaggacaaggagatgcagagctactccaccctcaaggccgtcaccaccagagccaccgtctccggcctcaagccgggcacccgctacgtgttccaggtccgagcccgcacctcagcaggctgtggccgcttcagccaggccatggaggtggagaccgggaaaccccggccccgctatgacaccaggaccattgtctggatctgcctgacgctcatcacgggcctggtggtgcttctgctcctgctcatctgcaagaagaggcactgtggctacagcaaggccttccaggactcggacgaggagaagatgcactatcagaatggacaggcacccccacctgtcttcctgcctctgcatcaccccccgggaaagctcccagagccccagttctatgcggaaccccacacctacgaggagccaggccgggcgggccgcagtttcactcgggagatcgaggcctctaggatccacatcgagaaaatcatcggctctggagactccggggaagtctgctacgggaggctgcgggtgccagggcagcgggatgtgcccgtggccatcaaggccctcaaagccggctacacggagagacagaggcgggacttcctgagcgaggcgtccatcatggggcaattcgaccatcccaacatcatccgcctcgagggtgtcgtcacccgtggccgcctggcaatgattgtgactgagtacatggagaacggctctctggacaccttcctgaggacccacgacgggcagttcaccatcatgcagctggtgggcatgctgagaggagtgggtgccggcatgcgctacctctcagacctgggctatgtccaccgagacctggccgcccgcaacgtcctggttgacagcaacctggtctgcaaggtgtctgacttcgggctctcacgggtgctggaggacgacccggatgctgcctacaccaccacgggcgggaagatccccatccgctggacggccccagaggccatcgccttccgcaccttctcctcggccagcgacgtgtggagcttcggcgtggtcatgtgggaggtgctggcctatggggagcggccctactggaacatgaccaaccgggatgtcatcagctctgtggaggaggggtaccgcctgcccgcacccatgggctgcccccacgccctgcaccagctcatgctcgactgttggcacaaggaccgggcgcagcggcctcgcttctcccagattgtcagtgtcctcgatgcgctcatccgcagccctgagagtctcagggccaccgccacagtcagcaggtgcccaccccctgccttcgtccggagctgctttgacctccgagggggcagcggtggcggtgggggcctcaccgtgggggactggctggactccatccgcatgggccggtaccgagaccacttcgctgcgggcggatactcctctctgggcatggtgctacgcatgaacgcccaggacgtgcgcgccctgggcatcaccctcatgggccaccagaagaagatcctgggcagcattcagaccatgcgggcccagctgaccagcacccaggggccccgccggcacctctgatgtacagccagcagggcccaggcagccaccaagcccaccccaggtcatgccagcggcagaggacgtgaggggctggcagcaggcagggcggccccaggcctctgccctcctctcaggtgctggaggagctgaaggcttcgccacaggacctggagttatcaggggtcaggcgcctgggaaggggcctttggtggccaccctggtgaggacacctgtcccccagggcaggcaccttctcttttccagagcctggggcctccacgtcacagagtccaacagggacatcactcgcctgcctctgtgtgcgtgcatgtgtgtgtgtggtggggggtgttctcacaaggtcatgggatctcatgtgaacagtgtgtgatcaagtgtgtccaccccttcgggtctcagcatggacgtgtgcatgttatgagcgtgtgcttatccgttaaggctggaggcacatgtgggtgatggtggatgatgtgtcatgaatgaggaggtgtgtgagcagggaactcagtgtgacaccgccaggtccagcacccatgggggcgggggagaggctcacccctacgtccccccacacctggaggctggagccaggggccacttctgaactgcaccagcaccaggcccaccctcgtctctgcctgggtgagcccaccccggctgtatctcaggtctgggtcctccctctagccgaggaggccacctgcagcctccacccggctctcaccgctgcttcaacaggaaaacagggttcccggtcagtccggctggccgccttcatggaggcatcatggcagagcacatgagatgtcctcagctgggcttggctgcctggccagggccgggggctcagcagcctcctctagcctctgatgccttccctccacggcccaggtctcctcactcaaagtcccttcgccaacctttcaatgcccagccctgacacctgccctttgtcccccaggcctaggatcagggaccagaggatcctatcttctcagcacccagcccaccccttcctgtagcatatggggagactaaggcctggagagaggggtgatgccccgtcccaggttgcactgcaaccaagtgtcagagtcggggctccggcctcctgccaaggctcttgtccccatacaccatcccacaagggcgctgggggtggaagtgccctggaagcccctcccctctcacactgacctccccccttacggcccaccagggtatgtaaatatctcttttctaccatgtcagaatattttttcctcactcctgacaatgcaaaaatggtcttcaaagcacataaaaagcacccagggtgagaaagccccatcccgggggccgttggcaggcagggaagcaggaaccccaccgtgtgccccctgccagccccagagggagtggcgagcccagctgcccagccctgccccccctccccatagccagcacagctatcccgcggggacaccagcactgagccccctctccctcctgcaataattcggggagtctcagccccatccaggtgccgcggccagctctctacacctctatatattatattactatatagccgagctgttcttccttcctatggaagtcggaaacatggtcagaacacgatctgggggggggatcctgtcttcctccccaccccaccccactcttacccaatttctgggctctggatcctcacagtcatggaggcaccgtgggcctggcacttgcaaaagtgtggcccctcactctagtgtgtggtccctctcagggtcctggggatctgcctctctgtggtctccatcctgactcttgaacttacccacaataagaataaattctgcctcatcttt

SEQ ID NO: 130087 - DNA, 1802 bp, Homo sapiens
  Payload ID: 5451
  Gene Symbol: EPHA8
  Gene Name: EPH receptor A8
  Uniprot ID: P29322
  ENST ID: ENST00000374644
  CDS Start-End: 73-1560
tcccgacgcgcgggccgcagcggccaagcccgagggtgcgtggcgcccccgcccgcccggcccggcccggccatggcccccgcccggggccgcctgccccctgcgctctgggtcgtcacggccgcggcggcggcggccacctgcgtgtccgcggcgcgcggcgaagtgaatttgctggacacgtcgaccatccacggggactggggctggctcacgtatccggctcatgggtgggactccatcaacgaggtggacgagtccttccagcccatccacacgtaccaggtttgcaacgtcatgagccccaaccagaacaactggctgcgcacgagctgggtcccccgagacggcgcccggcgcgtctatgctgagatcaagtttaccctgcgcgactgcaacagcatgcctggtgtgctgggcacctgcaaggagaccttcaacctctactacctggagtcggaccgcgacctgggggccagcacacaagaaagccagttcctcaaaatcgacaccattgcggccgacgagagcttcacaggtgccgaccttggtgtgcggcgtctcaagctcaacacggaggtgcgcagtgtgggtcccctcagcaagcgcggcttctacctggccttccaggacataggtgcctgcctggccatcctctctctccgcatctactataagaagtgccctgccatggtgcgcaatctggctgccttctcggaggcagtgacgggggccgactcgtcctcactggtggaggtgaggggccagtgcgtgcggcactcagaggagcgggacacacccaagatgtactgcagcgcggagggcgagtggctcgtgcccatcggcaaatgcgtgtgcagtgccggctacgaggagcggcgggatgcctgtgtggcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccggccaccctcggcaccagtgaacctgatctccagtgtgaatgggacatcagtgactctggagtgggcccctcccctggacccaggtggccgcagtgacatcacctacaatgccgtgtgccgccgctgcccctgggcactgagccgctgcgaggcatgtgggagcggcacccgctttgtgccccagcagacaagcctggtgcaggccagcctgctggtggccaacctgctggcccacatgaactactccttctggatcgaggccgtcaatggcgtgtccgacctgagccccgagccccgccgggccgctgtggtcaacatcaccacgaaccaggcaggtaggcggagaaactccgtcccgcagcgtcctggtcccccagcttcccctgcctcagacccatccagggatcagagctctgccggggacgtgctgtgggcctttaggcaagtgcctctctggccctgcgctcctcaccaggacccagagctggaggctcttcattgcctttagaaaagtggaacacattctataagtaagagaaatcccaaaagctcagaggcaggctagtgtggccgtcgaaagcctaggttccagaactttccctctctgtgcctcagtttcctccctggtgcaatgggaataatagtacctgcctgaggtcctctcaggaggcttaaatgagaggaatgaaattgcttagcccagcacctggcccgtggtaaatgctcaataaatgtcattaaaaaataaaa

SEQ ID NO: 130088 - DNA, 1773 bp, Homo sapiens
  Payload ID: 5451
  Gene Symbol: EPHA8
  Gene Name: EPH receptor A8
  Uniprot ID: P29322
  ENST ID: ENST00000538803
  CDS Start-End: 55-1542
gccgcagcggccaagcccgagggtgcgtggcgcccccgcccgcccggcccggccatggcccccgcccggggccgcctgccccctgcgctctgggtcgtcacggccgcggcggcggcggccacctgcgtgtccgcggcgcgcggcgaagtgaatttgctggacacgtcgaccatccacggggactggggctggctcacgtatccggctcatgggtgggactccatcaacgaggtggacgagtccttccagcccatccacacgtaccaggtttgcaacgtcatgagccccaaccagaacaactggctgcgcacgagctgggtcccccgagacggcgcccggcgcgtctatgctgagatcaagtttaccctgcgcgactgcaacagcatgcctggtgtgctgggcacctgcaaggagaccttcaacctctactacctggagtcggaccgcgacctgggggccagcacacaagaaagccagttcctcaaaatcgacaccattgcggccgacgagagcttcacaggtgccgaccttggtgtgcggcgtctcaagctcaacacggaggtgcgcagtgtgggtcccctcagcaagcgcggcttctacctggccttccaggacataggtgcctgcctggccatcctctctctccgcatctactataagaagtgccctgccatggtgcgcaatctggctgccttctcggaggcagtgacgggggccgactcgtcctcactggtggaggtgaggggccagtgcgtgcggcactcagaggagcgggacacacccaagatgtactgcagcgcggagggcgagtggctcgtgcccatcggcaaatgcgtgtgcagtgccggctacgaggagcggcgggatgcctgtgtggcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccggccaccctcggcaccagtgaacctgatctccagtgtgaatgggacatcagtgactctggagtgggcccctcccctggacccaggtggccgcagtgacatcacctacaatgccgtgtgccgccgctgcccctgggcactgagccgctgcgaggcatgtgggagcggcacccgctttgtgccccagcagacaagcctggtgcaggccagcctgctggtggccaacctgctggcccacatgaactactccttctggatcgaggccgtcaatggcgtgtccgacctgagccccgagccccgccgggccgctgtggtcaacatcaccacgaaccaggcaggtaggcggagaaactccgtcccgcagcgtcctggtcccccagcttcccctgcctcagacccatccagggatcagagctctgccggggacgtgctgtgggcctttaggcaagtgcctctctggccctgcgctcctcaccaggacccagagctggaggctcttcattgcctttagaaaagtggaacacattctataagtaagagaaatcccaaaagctcagaggcaggctagtgtggccgtcgaaagcctaggttccagaactttccctctctgtgcctcagtttcctccctggtgcaatgggaataatagtacctgcctgaggtcctctcaggaggcttaaatgagaggaatgaaattgcttagcccagcacctggcccgtggtaaatgctcaataaatgtcatt

SEQ ID NO: 130089 - DNA, 4672 bp, Homo sapiens
  Payload ID: 5452
  Gene Symbol: EPHB1
  Gene Name: EPH receptor B1
  Uniprot ID: P54762
  ENST ID: ENST00000398015
  CDS Start-End: 371-3325
tctggccggctccgtcctcccgtaggctccgctgtagctagcaatgtgacaccaggacgcactcgctctcgcgcgctctcccaggctcgttctccctcgccctctctctctcacacacgcacgcacacacccacctctcccataaacacacacacacacatgcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttgggggaaggctgatgaaggtaaacacagaagtcaggagctttgggcctcttactcggaatggtttttacctcgcttttcaggattatggagcctgtatgtctcttctttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggatggggaatggatggtgcctattgggcgatgcacctgcaagcctggctatgagcctgagaacagcgtggcatgcaaggcttgccctgcagggacattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagacgtccatcattctggagtggcaccctccaagggagacaggtgggcgggatgatgtgacctacaacatcatctgcaaaaagtgccgggcagaccgccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccaggagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaagtgaagacaaaacaatatgcatcaggagaacaagagtaaacccagctcccattctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctgcaaaaaggaaaaagaaaccacaaattggggaaaaaaaaagaagaaaaacctgtttccgtgtgcaaaagcacacatatgtatgtctgtgttataaaatgactgtgcttgttcgtaacagatgcaaacaagaaagaagaactgggaagtctttgtccctaggaaatccaaaggggctggaatatggtgttggtttggctttctggttggcccaatcggcctattggctcaatgggaagagaggagagggagaaaaataaaatgaaaggaaaaaaaaaagtttgcaaattcagacaggaaacaggtgagtggtttgaattggatgcagtgtgggccatcctggaatgatactgactgattaattattcctgataacatctcaagaaaaggagaaggaaagtgtttctggagaatgttctttcacatcactggaatctgcaattcaagaagtgacaagggagaattcttgctttacctatggactggcttaagccgtgtggcatccgaggaatgtttcaaatgtgtctgtgtttctctttacattccttgttgtacctcattgttcaattcacttttgtaaattccacctaacatttaattattttaaatttctccttttaccttaatctccttgctaattttatctgtctaattaaaaagagcagaagcatgtctgggtttacgtaaaa

SEQ ID NO: 130090 - DNA, 511 bp, Homo sapiens
  Payload ID: 5452
  Gene Symbol: EPHB1
  Gene Name: EPH receptor B1
  ENST ID: ENST00000473867
  CDS Start-End: 204-511
agatgcctgcaacagcagaatgagaagaaagcagggaaatgctctgtatcggccaaataaaatcaatctggctctcagatgcattggaaacttcaaattaaagcaggacaaatagcctaaggaggcttcacaaggatggaggcagtaggatgagagattcctgaaaggaggcagggatgactacatcataaaaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaa

SEQ ID NO: 130091 - DNA, 564 bp, Homo sapiens
  Payload ID: 5452
  Gene Symbol: EPHB1
  Gene Name: EPH receptor B1
  ENST ID: ENST00000460895
  CDS Start-End: 227-564
ttttttcacgtgtgaaaacatctattgggaaaatggaaaaatcatttgacctcatattcctcatagctgacatgacaaaaccaaaatgtggtggtgagccaacttcaattttgcagaaactgacttggaaagaactgattacctgaaggaccgtgaggatcaaagttgtcccactgaccaggctgtaaactttggaactgataagtgagagagataagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacct

SEQ ID NO: 130092 - DNA, 554 bp, Homo sapiens
  Payload ID: 5452
  Gene Symbol: EPHB1
  Gene Name: EPH receptor B1
  ENST ID: ENST00000474732
  CDS Start-End: 106-554
gatttttgtaggtgcatccaactgcaacagaatacatcagcctcatcggaaggagaatggaaggcctgagaacgcacaaaaggagcatttggagaggaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttgggggaaggctgatgaaggtaaacacagaagtcaggagctttgggcctcttactcggaatgg

SEQ ID NO: 130093 - DNA, 2786 bp, Homo sapiens
  Payload ID: 5452
  Gene Symbol: EPHB1
  Gene Name: EPH receptor B1
  Uniprot ID: P54762
  ENST ID: ENST00000493838
  CDS Start-End: 899-2536
actcccaccatccccctctaacagcacggagtcagtttccaggcagtgggcaaggagggctaagaacttgccccaggctacctgcctcccagctgaaaagggctttagttcttcccctgcctgtggagtctgcatgccagattcgcaccctcccctgagttctggccaggaggcttctgaacaagttcatattgttacaaagttcagctggagacttccttctccctgtggcattttcccagtgcctctggctgccctcctgagggatccctgtggtgccaggcaggaatttcctgcttggggaacccagtgggctcccagagcctttctcgcagcttcctctacccctgtatttcgctcggctctctaaattgactcagctccagcttgccctgcagggacattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagacgtccatcattctggagtggcaccctccaagggagacaggtgggcgggatgatgtgacctacaacatcatctgcaaaaagtgccgggcagaccgccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccaggagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaa

SEQ ID NO: 130094 - DNA, 389 bp, Homo sapiens
  Payload ID: 5452
  Gene Symbol: EPHB1
  Gene Name: EPH receptor B1
  ENST ID: ENST00000497173
  CDS Start-End: 262-389
cttttctccagctcgcagtccacgggctagtggactctgcttggcgtgcaagcactgcgcgcgggggccggagaagctctgccgtggtatcccgcaagtggccgccgaaggagaggggtggagttcattggccgtacccttggggaccagtctggtggtccgggcgcctgcgggactgcaggtttccagggtcagtcggggagaggtggaaacccttttcgcctcttgagccttggaacaggagtgggctgggaaacgttaatggacaccagaacggctactgcagagctgggctggacggccaatcctgcgtccgggtgggaagaagtcagtggctacgatgaaaacctgaacaccatccgcacctaccaggtgtgcaatgtcttcga

SEQ ID NO: 130095 - DNA, 1496 bp, Homo sapiens
  Payload ID: 5452
  Gene Symbol: EPHB1
  Gene Name: EPH receptor B1
  ENST ID: ENST00000482618
  CDS Start-End: 371-1216
tctggccggctccgtcctcccgtaggctccgctgtagctagcaatgtgacaccaggacgcactcgctctcgcgcgctctcccaggctcgttctccctcgccctctctctctcacacacgcacgcacacacccacctctcccataaacacacacacacacatgcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttgggggaaggctgatgaaggtaaacacagaagtcaggagctttgggcctcttactcggaatggtttttacctcgcttttcaggattatggagcctgtatgtctcttctttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggatggggaatggatggtgcctattgggcgatgcacctgcaagcctggctatgagcctgagaacagcgtggcatgcaaggtgtccaggcctttttggaggatccttagacagcaggattgacattggaggagcctggtatttctgccacactcacacagcctcctctgcatccaccccctctgaggaagcagcttgccctgcagggacattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagacgtccatc

SEQ ID NO: 130096 - DNA, 4014 bp, Homo sapiens
  Payload ID: 5453
  Gene Symbol: EPHB2
  Gene Name: EPH receptor B2
  ENST ID: ENST00000374627
  CDS Start-End: 25-2865
taacacagttgtgaaaatagatggatgtgggttccagtcctagccctgcctgtgtgcacttatgcagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaagcaggagctcagtgagtacaacgccacagccataaaaagccccaccaacacggtcaccgtgcagggcctcaaagccggcgccatctatgtcttccaggtgcgggcacgcaccgtggcaggttacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggagtaagtgcccagccacttctgcttgtcaccttagcaccccctctccaccggccccaccagccaagtggggtgatctggagggtgaggaatagatcatgtcccaatagggaagcagggaccaaggggcaagatggccaactttggagtcacctgtggactgatacccaggtctgcctgccacctacaagctctgtgaccttggtcaaatcatagcacctccctcagcctccgttttctcacctacaaactgggggttggtaggaaggttgagggagatataaaggaagcgggtgcttagaaaatgcaagctggcagccgggcacagtggctcatgcctgtaatcttagtacattgggaggccgaggcgggcagatcacaaggtcaggagttcaagaccagcctgaccaacatggtgaaaccccgtctctactaaaatgcaaaaaattagccacgcaaggtggcatgcacctgtaatgccagctactcgggaggctgaggcaggggaattgcttgaaccaaggaggtagaggttgcagtgagctgagatcacgccactgcacaccagcctgggtgacagagcgagactctgtctcgaaaaagaaagaaaatgtaagctggcttccccctcccaatagcaggggagagaaggccccctagggaccctgattccgactcaagtgctcttccacctcacaccatagtcgctccctccagctgtggctgcctgcccactccccactccccactccccagtactccttgctttgccatcttcctcccggggaagcccaggcagctctctaccaggcacaggaccccttcacccgcatatttccctaacacacgtgcttctctcccaaagggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacgg

SEQ ID NO: 130097 - DNA, 3152 bp, Homo sapiens
  Payload ID: 5453
  Gene Symbol: EPHB2
  Gene Name: EPH receptor B2
  Uniprot ID: P29323
  ENST ID: ENST00000374630
  CDS Start-End: 19-2979
gccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggttacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactc

SEQ ID NO: 130098 - DNA, 3677 bp, Homo sapiens
  Payload ID: 5453
  Gene Symbol: EPHB2
  Gene Name: EPH receptor B2
  Uniprot ID: P29323
  ENST ID: ENST00000374632
  CDS Start-End: 14-2977
gggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggttacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagaagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccag

SEQ ID NO: 130099 - DNA, 10816 bp, Homo sapiens
  Payload ID: 5453
  Gene Symbol: EPHB2
  Gene Name: EPH receptor B2
  Uniprot ID: P29323
  ENST ID: ENST00000400191
  CDS Start-End: 19-3186
gccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggttacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataatatgacccctgttctctgtaagttccaagggagaccttggtacccttgggatgcacgtgacccaggtgctaagggttgctcttctaagcagcccttcctccctcaggcttccagaaagcccagggcagagaaaacacatggagaacgacagctccacgtggcctttctggccctggcttgtcaaaagcacaggcaacaaaggaagtgagttggaagtggctcagaactcagccttcgatgccctgggaatcagggtgagcccctgcaggtacataagtagcagagaattgacgagagtgcactcggaagagggtctgagtgtcaggtgagctgtcatagtgggaacgtgagggtcttagagtgctcatgtacccccaggcacagccaactctggttttctctgtgcaaatgagctcttgctcacattaaaatcagaattgtccacgtggcaggaggaggcagggagatggatgtgccatggatatcgggtctggctgaggaaggggagccaaggagactacctctcgggacctttcccagatccgaggagatggccagtgagaaagattcgggccacaggcagccagctagaagcgccacggtcagagtgaacatccagcacagcacagcccatcgtctgtcactcacctgttccgggagcctgagctgcaaagggaaggaagggattagagagaagtgtgggccccccatggggacagcagggcaagccacagggaaagcattggcaggtttcccacaaactggccggcagtggcccactggccttcactttgtgccccaaaggtgccctgcgcgggtggcagctgtctcggcacacaaggtcaccttctggtgggagctgccctgatgctctttagattagttctgtctccccagcccaccccccaactgttctggggccccacatggggctggcagtcggtgcttcccgtcagatggcttcctgtcctaagccgctgagctggtgaccactagccagcatgtctgcccctccaccctccagggccgaggtcctcagtggccatggccccctgcaaacctgcttcccagagcacaggtgctaccagacctctgtgtctccacttcagggtaacaaacagatgtcactgtgactgtcccaggggtacaggcgctgctcacatctcttccacccccacccacccaccccacccgctaccggggcagtcgccccgccccaacctcttgcttgctgctcagcggggagtggcaggccatgttgccaagcgccttccacttacaccacccgctcacccaggcacacagctctgagccacccgctgcctggttactaatcctttcctggctcaacctccccaagtgccagcccccgcctgcccagcagtgttaggggagtttccggctgctctgcacacagttggtactgcaggaaagaaagctgccttgtaaacacaggccagggcaccgtggaaatggggaccagctgctctgggagggtgcagctagcagagctgtgcagcgccaggctgggtaggagagagccatgctacccacccgcacccctactgctacgaagcccccagaatgggtcattgttggtgctcagcagtcctctccctcggggatgatatccaaaatatcaactgcgaagactcgggcagaccaatcagaatagatgatggcctgagtgctggaccagaggcctcagagcagggacccgggtggcggggcagtaggagacacttaagggactcagggctatggctgtttactaaccagcagtgcctcttactcagatggcatcagctgaactttccccatcatttctagttggtccccaccctgccaccatctaggggcttctctgccaccaccttgtgagcagttgctagcctcacactcctctcccatcaggggctcatctccaaaaggctgggagctcccgccctgcccagttaatcctcctgcctcactgaagcacaggaaggacccaggccccagaccatcacccaccccagggctgggccctgggccactcctggctcactccagggcccctgttgtttgaagatggtaccaaaggctggaagactcttgctagggaagataacgtaaatgcattcaaaagacagggtaccacatgatgctagggaaagtgcgtcatgaccgcagggtagcagcctgctcctgtcactagggatgtgaatctggggagacacttcccctcactgagccatctgtaaaatgagagcattggactgggtgaggcaggctgtgcaaaacacttatacaccttagtcccatgaggaaggagtattccccctgcatattttggggggaaactgaggctcagggggatgaagtactttgctcagggtaacacagccaggaaggagcagagcaaggccatgagctttggatttttctgtttccaatgtctcctctaccgtgctcaattagatgatgagaaacagttggtgtctgatgctggccaataagagaaaagaaagctcaagtgggctggggctgtcagggagggcttcatggagaggctgtcttgaaaatgacagaggtcaaaagaaaggtcactccaagacgcagctgccagaatggtccaacacagtgaggagttgtgtctggatgggccagtggaacgggggaagtgaaggttgatataagtggaggttgaggcagtttaggcgtgatgtacagtccagccacagcaggttcttgagcaggagggtagcatagtgagcatcaggttctaggaagaagcaccagttcagccatcagatggggcaggatgcctcccagctactcctctccccgagaaggaattgcccccggagcggccctcatttattccaggagaagccaggccctgctgcttcagtttccatcctcactgacgcagataatccaaagagtcacttcagctgcttggaacagcagggttgggtcttgtgctacctgattcttaatttggctgatgtctaccccatttcctccaggcttctctagaggtggcaggggtggggtggggagaaagctgccagacaccaaaggagctgagcctggcgggggcgggcgtgcgggtgggcatgagaaattgctcaggaaacccatccctgccctggtcaccctagtcctggagagatcacccagacatgttggaatgagtctggggtcctgtcttttccaataatgtgttatcctggggaaacccagagggaagttgagggagccccactgtgctgtgtgatgctacatacgcatgcgaatacaccaccgggtggccttgacccagccttctgcaaaatggcttctgccatcaaacttaaggtggagaatggtcttgcagctgccagtttttccttcagagaaactaaggtcagagtgttggctgcagaaaaggacttggcctttgtcacataacaggaaagagagtcaactccgggcacaccccctcggaggctaatctcaggaggttggaaccacagggattgcaataatcgctgaatacttaccatatgccaggtgccaaagcattatcctctccactttatgagtgaggaaactgattcccagaggtgattcccagaagattccaaccaggccatctgtctgtagtccttccttcccacctcctgggatttctcaaaatgtttgccatcgcccacctgtatcagaatctcctgggctatttattgtttaacttgcagactcctgggcgccaccccaaccccctaaatcagaatccctggggttgggcccaagagtctccattttttgacaagctcctccaggagattcctccagacatggaaatcctcacttgactcttcccccataacaaactgccctgatgtctgcagagagagggtctgctgtagacagggattaagaaaaagcaggacattttcagataggatgcccaaacccagacgcagattaggacccatgaagtagggggtagagctgaccctcaggaatgtgcccagacagagctaagctttcaggaaaattagaaagaccctcagacccagagtctgtctgagtttagcttcgcagcatgaaggctgccttgagaaagctgatataacaagaagcagcagaaatttaatactttggaggggcccagcaacccactcagggccaccctgggagaccccacagaccccaaggctatggtccagacctgttcactcaacacctggccaggcggggcctccagctggacctagagctacagatgccccaccaccactaccaagcccggctacccagaccaagacacggcttttcctggaggagagagagagcaaaggccctgtctctacccaagacctaacggcccctgttgaaggagagggagcaggagagggaggagggaggaggtcacagccaggaccacatacactcttgggggccctgctgagactgcaagagtcatgaattctaacgttccacaggtgaaagattccaagattctaggattgcaaaaccccatcattctaagattccaatggaatgattccatgtttctaagattccatcacactatgattctatgctgctaattcttgaaatttcgagtctcattgttcgttgctgttccccagacctgtgggccctagcatttttttaaaagcacaaaaaaaaaagagcaagaaagagagaaagagatggggagggagacagctgaaaacagatactaagaaaagctccatcccttggatctgagttacagatgcaccttggcaagggccaaagaccctccttttgagtggggtgcagaacgtctttccctggtagagtggcagaattgcatgcatcaggccttcctgggggtaaaaggggctggctgttccaggctacagctgagtaaagccccacacaggccacagtgcccactggctggtggacctaggaaccaagcagggccccactggctcagtctggggagggactcatctggggtggaatttccctccctgcagcaaggaagctgcagggccaggaatttgccttgggagacccccactgaggaatatttccgaagcagaaccccttcctattcagagccagagtcttaacactggacaaccacagggtgttgctgcaaactccagagccaggtgccttccctctgacatttgggacatagcttccatggccacacagccttcgcccccttccaagaccccccttgacctttctaatcttagtcactgccttccagagctgggaggccacacggcagaggtgcctgtgaatcactccgtcatcagcctggccgctttcccctctgtggagagggactctgatgggcagggggcaccaagttgagcctctgaggctggcccagcataggccaggcagggacattcactcacaaccagcctttttggactctagagaagagtaattaccacttggtcatgcccagcccccaaatcataatcatagctgctatttcttgagtgccagcaatgtgccaggcaccgtgcccaactttttatacacaatgtcttgcctaatcctcacacctctgtgagacaggtacaattattactcccattccacagactagcaaactcagagacgtgacatggtggctctcccaggtcacacagccagtaagtggcctctgaccccagtaccccccacttaatcaccatgctatgctgctaccagtggtacacactcagcccctctccactgtcagatcctttgccagtcaaatcccagatccccgggggggcactgtggcaccctctttgagcgtggcctccctggagctgctgtcagagccatgggctgtgggagtgagtgtgcacactccttctcctgaagtgtctgccccagcctgagctatgcagaccggagctctcaaccagggtatggggctgtctggcagggtttcccagaaccctgtttcctgtggtcataaatatgggttttcctgacaatgttgggaggtcagggactgatacagctggggttccaaccgccgtgggtcagacctggctcctccggaccccactgctgtgaccaaggaaatctcaccagctgtgtccaagatcaaccctgaccctgttactccaatgcctttgtaggagtatttttagcagaaccgtttttttcccaaaataaatgtgaattgtaaaaatta

SEQ ID NO: 130100 - DNA, 1709 bp, Homo sapiens
  Payload ID: 5453
  Gene Symbol: EPHB2
  Gene Name: EPH receptor B2
  ENST ID: ENST00000544305
  CDS Start-End: 145-1593
attctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaagatgaagacacagagaagttaaggaacttgcccaaggtcacagaggtcatatatactagagccaggatttgaacccaagaagtctggctccagcttgtgatcttaacctccatgctataaagcctgtaataacattgc

SEQ ID NO: 130101 - DNA, 4236 bp, Homo sapiens
  Payload ID: 5454
  Gene Symbol: EPHB3
  Gene Name: EPH receptor B3
  Uniprot ID: P54753
  ENST ID: ENST00000330394
  CDS Start-End: 453-3449
cagcagaagtgagtacgtgagcggcgcagcaagatcccagctcggaccccggacggcgcgcgcccccgaagccccggatcccagtcgggcccgcagctgaccgccagattactgtgcatcccgaatcacgaccacctgcaccctcctgccccggcccgccccccaagtcctcaggcacccagctccccggcgccccggatcctcctggaccggtccgtccagattcccgcgggaccgacctgtccgcatccccaggaccgccgggctcggtgcaccgcctcggtcccggagccgcccgcctggattgcattccctcctctcctggatctcctgggacccgacgcgagcctgccccggagcccgccgagcgcaccctctctcgggtgcctgcagccccgccggcgcggcccggcccggcgcggcccggctcggctcctagagctgccacggccatggccagagcccgcccgccgccgccgccgtcgccgccgccggggcttctgccgctgctccctccgctgctgctgctgccgctgctgctgctgcccgccggctgccgggcgctggaagagaccctcatggacacaaaatgggtaacatctgagttggcgtggacatctcatccagaaagtgggtgggaagaggtgagtggctacgatgaggccatgaatcccatccgcacataccaggtgtgtaatgtgcgcgagtcaagccagaacaactggcttcgcacggggttcatctggcggcgggatgtgcagcgggtctacgtggagctcaagttcactgtgcgtgactgcaacagcatccccaacatccccggctcctgcaaggagaccttcaacctcttctactacgaggctgacagcgatgtggcctcagcctcctcccccttctggatggagaacccctacgtgaaagtggacaccattgcacccgatgagagcttctcgcggctggatgccggccgtgtcaacaccaaggtgcgcagctttgggccactttccaaggctggcttctacctggccttccaggaccagggcgcctgcatgtcgctcatctccgtgcgcgccttctacaagaagtgtgcatccaccaccgcaggcttcgcactcttccccgagaccctcactggggcggagcccacctcgctggtcattgctcctggcacctgcatccctaacgccgtggaggtgtcggtgccactcaagctctactgcaacggcgatggggagtggatggtgcctgtgggtgcctgcacctgtgccaccggccatgagccagctgccaaggagtcccagtgccgcccctgtccccctgggagctacaaggcgaagcagggagaggggccctgcctcccatgtccccccaacagccgtaccacctccccagccgccagcatctgcacctgccacaataacttctaccgtgcagactcggactctgcggacagtgcctgtaccaccgtgccatctccaccccgaggtgtgatctccaatgtgaatgaaacctcactgatcctcgagtggagtgagccccgggacctgggtggccgggatgacctcctgtacaatgtcatctgcaagaagtgccatggggctggaggggcctcagcctgctcacgctgtgatgacaacgtggagtttgtgcctcggcagctgggcctgacggagcgccgggtccacatcagccatctgctggcccacacgcgctacacctttgaggtgcaggcggtcaacggtgtctcgggcaagagccctctgccgcctcgttatgcggccgtgaatatcaccacaaaccaggctgccccgtctgaagtgcccacactacgcctgcacagcagctcaggcagcagcctcaccctatcctgggcacccccagagcggcccaacggagtcatcctggactacgagatgaagtactttgagaagagcgagggcatcgcctccacagtgaccagccagatgaactccgtgcagctggacgggcttcggcctgacgcccgctatgtggtccaggtccgtgcccgcacagtagctggctatgggcagtacagccgccctgccgagtttgagaccacaagtgagagaggctctggggcccagcagctccaggagcagcttcccctcatcgtgggctccgctacagctgggcttgtcttcgtggtggctgtcgtggtcatcgctatcgtctgcctcaggaagcagcgacacggctctgattcggagtacacggagaagctgcagcagtacattgctcctggaatgaaggtttatattgacccttttacctacgaggaccctaatgaggctgttcgggagtttgccaaggagatcgacgtgtcctgcgtcaagatcgaggaggtgatcggagctggggaatttggggaagtgtgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccggctcaacgatgggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctgggcgggaagatccccatccgctggactgccccagaggccatagcctatcggaagttcacttctgctagtgatgtctggagctacggaattgtcatgtgggaggtcatgagctatggagagcgaccctactgggacatgagcaaccaggatgtcatcaatgccgtggagcaggattaccggctgccaccacccatggactgtcccacagcactgcaccagctcatgctggactgctgggtgcgggaccggaacctcaggcccaaattctcccagattgtcaataccctggacaagctcatccgcaatgctgccagcctcaaggtcattgccagcgctcagtctggcatgtcacagcccctcctggaccgcacggtcccagattacacaaccttcacgacagttggtgattggctggatgccatcaagatggggcggtacaaggagagcttcgtcagtgcggggtttgcatcttttgacctggtggcccagatgacggcagaagacctgctccgtattggggtcaccctggccggccaccagaagaagatcctgagcagtatccaggacatgcggctgcagatgaaccagacgctgcctgtgcaggtctgacaccggctcccacggggaccctgaggaccgtgcagggatgccaagcagccggctggactttcggactcttggacttttggatgcctggccttaggctgtggcccagaagctggaagtttgggaaaggcccaagctgggacttctccaggcctgtgttccctccccaggaagtgcgccccaaacctcttcatattgaagatggattaggagagggggtgatgacccctccccaagcccctcagggcccagaccttcctgctctccagcaggggatccccacaacctcacacttgtctgttcttcagtgctggaggtcctggcagggtcaggctggggtaagccggggttccacagggcccagccctggcaggggtctggccccccaggtaggcggagagcagtccctccctcaggaactggaggaggggactccaggaatggggaaatgtgacaccaccatcctgaagccagcttgcacctccagtttgcacagggatttgttctgggggctgagggccctgtccccacccccgcccttggtgctgtcataaaagggcaggcaggggcaggctgaggagttgccctttgccccccagagactgactctcagagccagagatgggatgtgtgagtgtgtgtgtgtgtgtgtgtgtgtgcgcgcgcgcgcgcgtgtgtgtgtgcacgcactggcctgcacagagagcatgggtgagcgtgtaaaagcttggccctgtgccctacaatggggccagctgggccgacagcagaataaaggcaataagatgat

SEQ ID NO: 130102 - DNA, 4329 bp, Homo sapiens
  Payload ID: 5455
  Gene Symbol: EPHB4
  Gene Name: EPH receptor B4
  Uniprot ID: P54760
  ENST ID: ENST00000358173
  CDS Start-End: 470-3433
cccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 130103 - DNA, 3789 bp, Homo sapiens
  Payload ID: 5455
  Gene Symbol: EPHB4
  Gene Name: EPH receptor B4
  ENST ID: ENST00000360620
  CDS Start-End: 86-2893
cgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 130104 - DNA, 3737 bp, Homo sapiens
  Payload ID: 5455
  Gene Symbol: EPHB4
  Gene Name: EPH receptor B4
  Uniprot ID: P54760
  ENST ID: ENST00000616502
  CDS Start-End: 492-1412
ttccagcgcagctcagcccctgcccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 130105 - DNA, 3436 bp, Homo sapiens
  Payload ID: 5456
  Gene Symbol: EPHB6
  Gene Name: EPH receptor B6
  ENST ID: ENST00000422643
  CDS Start-End: 180-3248
ggtggctgttggaggaagggaggagagtaaatgaagagaaagaactggaataaccccttgcagaaaaaaaaaaaaagggaagcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagaggtattgctggacaccaccggagagacatctgagattggctggctcacctacccaccaggggggtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaaggtggacacaattgcagcagacgagagctttccctcctcctcctcctcctcctcctcctcttcttcctctgcagcgtgggctgtgggaccccacggggctgggcagcgggctggactgcaactgaacgtcaaagagcggagctttgggcctctcacccaacgcggcttctacgtggccttccaggacacgggggcctgcctggccctggtcgctgtcaggctcttctcctacacctgccctgccgtgctccgatcctttgcttcctttccagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataaggcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccagaaagactctccttggtgatcggctccatcctgggggctttggccttcctcctgctggcagccatcaccgtgctggcggtcgtcttccagcggaagcggcgtgggactggctacacagagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaatttgc

SEQ ID NO: 130106 - DNA, 3367 bp, Homo sapiens
  Payload ID: 5456
  Gene Symbol: EPHB6
  Gene Name: EPH receptor B6
  ENST ID: ENST00000411471
  CDS Start-End: 990-3179
ggtggctgttggaggaagggaggagagtaaatgaagagaaagaactggaataaccccttgcagaaaaaaaaaaaaaggcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaaggtggacacaattgcagcagacgagagctttccctcctcctcctcctcctcctcctcctcttcttcctctgcagcgtgggctgtgggaccccacggggctgggcagcgggctggactgcaactgaacgtcaaagagcggagctttgggcctctcacccaacgcggcttctacgtggccttccaggacacgggggcctgcctggccctggtcgctgtcaggctcttctcctacacctgccctgccgtgctccgatcctttgcttcctttccagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataaggcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccagaaagactctccttggtgatcggctccatcctgggggctttggccttcctcctgctggcagccatcaccgtgctggcggtcgtcttccagcggaagcggcgtgggactggctacacagagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaatttgc

SEQ ID NO: 130107 - DNA, 3224 bp, Homo sapiens
  Payload ID: 5456
  Gene Symbol: EPHB6
  Gene Name: EPH receptor B6
  ENST ID: ENST00000611578
  CDS Start-End: 279-830
caagatcagggtgccggcatggtcagttcctggcgaagcctctcttctaggtttcagactgccctcttctttgttgtgtcctcgaatggcagaaaaaggggtggctgttggaggaagggaggagagtaaatgaagagaaagaactggaataaccccttgcagaaaaaaaaaaaaagggaagcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagaggtattgctggacaccaccggagagacatctgagattggctggctcacctacccaccaggggggtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataaggcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccagaaagactctccttggtgatcggctccatcctgggggctttggccttcctcctgctggcagccatcaccgtgctggcggtcgtcttccagcggaagcggcgtgggactggctacacagagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaa

SEQ ID NO: 130108 - DNA, 3365 bp, Homo sapiens
  Payload ID: 5456
  Gene Symbol: EPHB6
  Gene Name: EPH receptor B6
  ENST ID: ENST00000615824
  CDS Start-End: 989-3178
ggtggctgttggaggaagggaggagagtaaatgaagagaaagaactggaataaccccttgcagaaaaaaaaaaaaggcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaaggtggacacaattgcagcagacgagagctttccctcctcctcctcctcctcctcctcctcttcttcctctgcagcgtgggctgtgggaccccacggggctgggcagcgggctggactgcaactgaacgtcaaagagcggagctttgggcctctcacccaacgcggcttctacgtggccttccaggacacgggggcctgcctggccctggtcgctgtcaggctcttctcctacacctgccctgccgtgctccgatcctttgcttcctttccagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataagtcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccggaaagactctccttggtgatcggctccatcctgggggctttggccttcctcctgctggcagccatcaccgtgctggcggtcgtcttccagcggaagcggcgtgggactggctacacggagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggctgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctccgatggctgcattccctggtcctccgcctctccaccagccccctcctcattaaagggaaagaagggaatttgc

SEQ ID NO: 130109 - DNA, 3434 bp, Homo sapiens
  Payload ID: 5456
  Gene Symbol: EPHB6
  Gene Name: EPH receptor B6
  ENST ID: ENST00000618483
  CDS Start-End: 179-3247
ggtggctgttggaggaagggaggagagtaaatgaagagaaagaactggaataaccccttgcagaaaaaaaaaaaagggaagcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagaggtattgctggacaccaccggagagacatctgagattggctggctcacctacccaccaggggggtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaaggtggacacaattgcagcagacgagagctttccctcctcctcctcctcctcctcctcctcttcttcctctgcagcgtgggctgtgggaccccacggggctgggcagcgggctggactgcaactgaacgtcaaagagcggagctttgggcctctcacccaacgcggcttctacgtggccttccaggacacgggggcctgcctggccctggtcgctgtcaggctcttctcctacacctgccctgccgtgctccgatcctttgcttcctttccagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataagtcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccggaaagactctccttggtgatcggctccatcctgggggctttggccttcctcctgctggcagccatcaccgtgctggcggtcgtcttccagcggaagcggcgtgggactggctacacggagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggctgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctccgatggctgcattccctggtcctccgcctctccaccagccccctcctcattaaagggaaagaagggaatttgc

SEQ ID NO: 130110 - DNA, 4011 bp, Homo sapiens
  Payload ID: 5456
  Gene Symbol: EPHB6
  Gene Name: EPH receptor B6
  ENST ID: ENST00000619012
  CDS Start-End: 753-3821
cggagggggcgggccgggctgcgttcgctccagccgcggctctacagcagcgggcggcgggacccgggacccagcttggcgacggcgatctcgacgcgggcccccaggatctcccggcgccccacctctggagcagcccctgccgccagcgtcaggtccaccccggaatcccagggactctcggcgccgaacggacccgggccgggtgcaacggggtccccggactggagaagacgcgggtggcaccgtgcgagctccaggagccccgggtccactgcgaggcctcggggggcgcagacctgcagagactgcggccaacgggaagaaataaagggattatagtccacccaattcacagacttctgagactcagacacgaggagagatagagaaccgccaatctctaaatcaacaagcaaaggaggtgccaagcctgtttgtcttcattgtgacactggagtctagatgctgggaagtccaagatcagggtgccggcatggtcagttcctggcgaagcctctcttctaggtttcagactgccctcttctttgttgtgtcctcgaatggcagaaaaaggggtggctgttggaggaagggaggagagtaaatgaagagaaagaactggaataaccccttgcagaaaaaaaaaaaaaggcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagaggtattgctggacaccaccggagagacatctgagattggctggctcacctacccaccaggggggtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaaggtggacacaattgcagcagacgagagctttccctcctcctcctcctcctcctcctcctcttcttcctctgcagcgtgggctgtgggaccccacggggctgggcagcgggctggactgcaactgaacgtcaaagagcggagctttgggcctctcacccaacgcggcttctacgtggccttccaggacacgggggcctgcctggccctggtcgctgtcaggctcttctcctacacctgccctgccgtgctccgatcctttgcttcctttccagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataaggcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccagaaagactctccttggtgatcggctccatcctgggggctttggccttcctcctgctggcagccatcaccgtgctggcggtcgtcttccagcggaagcggcgtgggactggctacacagagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaatttgcag

SEQ ID NO: 130111 - DNA, 528 bp, Homo sapiens
  Payload ID: 5456
  Gene Symbol: EPHB6
  Gene Name: EPH receptor B6
  ENST ID: ENST00000476059
  CDS Start-End: 1-339
ggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaagagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaatttgca

SEQ ID NO: 130112 - DNA, 3861 bp, Homo sapiens
  Payload ID: 5456
  Gene Symbol: EPHB6
  Gene Name: EPH receptor B6
  ENST ID: ENST00000614832
  CDS Start-End: 675-827
cggcgatctcgacgcgggcccccaggatctcccggcgccccacctctggagcagcccctgccgccagcgtcaggtccaccccggaatcccagggactctcggcgccgaacggacccgggccgggtgcaacggggtccccggactggagaagacgcgggtggcaccgtgcgagctccaggagccccgggtccactgcgaggcctcggggggcgcagacctgcagagactgcggccaacgggaagaaataaagggattatagtccacccaattcacagacttctgagactcagacacgaggagagatagagaaccgccaatctctaaatcaacaagcaaaggaggtgccaagcctgtttgtcttcattgtgacactggagtctagatgctgggaagtccaagatcagggtgccggcatggtcagttcctggcgaagcctctcttctaggtttcagactgccctcttctttgttgtgtcctcgaatggcagaaaaaggggtggctgttggaggaagggaggagagtaaatgaagagaaagaactggaataaccccttgcagaaaaaaaaaaaaagggaagcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaaggtggacacaattgcagcagacgagagctttccctcctcctcctcctcctcctcctcctcttcttcctctgcagcgtgggctgtgggaccccacggggctgggcagcgggctggactgcaactgaacgtcaaagagcggagctttgggcctctcacccaacgcggcttctacgtggccttccaggacacgggggcctgcctggccctggtcgctgtcaggctcttctcctacacctgccctgccgtgctccgatcctttgcttcctttccagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataaggcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccagaaagactctccttggtgatcggctccatcctgggggctttggccttcctcctgctggcagccatcaccgtgctggcggtcgtcttccagcggaagcggcgtgggactggctacacagagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaa

SEQ ID NO: 130113 - DNA, 4006 bp, Homo sapiens
  Payload ID: 5456
  Gene Symbol: EPHB6
  Gene Name: EPH receptor B6
  ENST ID: ENST00000632037
  CDS Start-End: 756-3824
cggagggggcgggccgggctgcgttcgctccagccgcggctctacagcagcgggcggcgggacccgggacccagcttggcgacggcgatctcgacgcgggcccccaggatctcccggcgccccacctctggagcagcccctgccgccagcgtcaggtccaccccggaatcccagggactctcggcgccgaacggacccgggccgggtgcaacggggtccccggactggagaagacgcgggtggcaccgtgcgagctccaggagccccgggtccactgcgaggcctcggggggcgcagacctgcagagactgcggccaacgggaagaaataaagggattatagtccacccaattcacagacttctgagactcagacacgaggagagatagagaaccgccaatctctagatcaacaagcaaaggaggtgccaagcctgtttgtcttcattgtgacactggagtctagatgctgggaagtccaagatcagggtgccggcatggtcagttcctggcgaagcctctcttctaggtttcagactgccctcttctttgttgtgtcctcgaatggcagaaaaaggggtggctgttggaggaagggaggagagtaaatgaagagaaagaactggaataaccccttgcagaaaaaaaaaaaagggaagcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagaggtattgctggacaccaccggagagacatctgagattggctggctcacctacccaccaggggggtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaaggtggacacaattgcagcagacgagagctttccctcctcctcctcctcctcctcctcctcttcttcctctgcagcgtgggctgtgggaccccacggggctgggcagcgggctggactgcaactgaacgtcaaagagcggagctttgggcctctcacccaacgcggcttctacgtggccttccaggacacgggggcctgcctggccctggtcgctgtcaggctcttctcctacacctgccctgccgtgctccgatcctttgcttcctttccagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataagtcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccggaaagactctccttggtgatcggctccatcctgggggctttggccttcctcctgctggcagccatcaccgtgctggcggtcgtcttccagcggaagcggcgtgggactggctacacggagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggctgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctccgatggctgcattccctggtcctccgcctctccaccagccccctcctcattaaagggaaagaagggaa

SEQ ID NO: 130114 - DNA, 3859 bp, Homo sapiens
  Payload ID: 5456
  Gene Symbol: EPHB6
  Gene Name: EPH receptor B6
  ENST ID: ENST00000634148
  CDS Start-End: 674-826
cggcgatctcgacgcgggcccccaggatctcccggcgccccacctctggagcagcccctgccgccagcgtcaggtccaccccggaatcccagggactctcggcgccgaacggacccgggccgggtgcaacggggtccccggactggagaagacgcgggtggcaccgtgcgagctccaggagccccgggtccactgcgaggcctcggggggcgcagacctgcagagactgcggccaacgggaagaaataaagggattatagtccacccaattcacagacttctgagactcagacacgaggagagatagagaaccgccaatctctagatcaacaagcaaaggaggtgccaagcctgtttgtcttcattgtgacactggagtctagatgctgggaagtccaagatcagggtgccggcatggtcagttcctggcgaagcctctcttctaggtttcagactgccctcttctttgttgtgtcctcgaatggcagaaaaaggggtggctgttggaggaagggaggagagtaaatgaagagaaagaactggaataaccccttgcagaaaaaaaaaaaagggaagcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaaggtggacacaattgcagcagacgagagctttccctcctcctcctcctcctcctcctcctcttcttcctctgcagcgtgggctgtgggaccccacggggctgggcagcgggctggactgcaactgaacgtcaaagagcggagctttgggcctctcacccaacgcggcttctacgtggccttccaggacacgggggcctgcctggccctggtcgctgtcaggctcttctcctacacctgccctgccgtgctccgatcctttgcttcctttccagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataagtcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccggaaagactctccttggtgatcggctccatcctgggggctttggccttcctcctgctggcagccatcaccgtgctggcggtcgtcttccagcggaagcggcgtgggactggctacacggagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggctgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctccgatggctgcattccctggtcctccgcctctccaccagccccctcctcattaaagggaaagaagggaa

SEQ ID NO: 130115 - DNA, 527 bp, Homo sapiens
  Payload ID: 5456
  Gene Symbol: EPHB6
  Gene Name: EPH receptor B6
  ENST ID: ENST00000633684
  CDS Start-End: 1-339
ggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaagagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctccgatggctgcattccctggtcctccgcctctccaccagccccctcctcattaaagggaaagaagggaatttgca

SEQ ID NO: 130116 - DNA, 654 bp, Homo sapiens
  Payload ID: 5456
  Gene Symbol: EPHB6
  Gene Name: EPH receptor B6
  ENST ID: ENST00000632242
  CDS Start-End: 1-357
tttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctccgatggctgcattccctggtcctccgcctctccaccagccccctcctcattaaagggaaagaagggaatttgc
